(12) United States Patent
Cunningham et al.

(10) Patent No.: US 7,910,101 B2
(45) Date of Patent: Mar. 22, 2011

(54) MELANOCORTIN RECEPTOR BINDING MIMETIBODIES, COMPOSITIONS, METHODS AND USES

(75) Inventors: Mark Cunningham, Radnor, PA (US); Vedrana Stojanovic-Susulic, Radnor, PA (US); Karyn O'Neil, Radnor, PA (US); Chichi Huang, Radnor, PA (US); Jeffrey Luo, Radnor, PA (US)

(73) Assignee: Centocor, Inc., Malvern, PA (US)

( * ) Notice: Subject to any disclaimer, the term of this patent is extended or adjusted under 35 U.S.C. 154(b) by 204 days.

(21) Appl. No.: 11/929,046

(22) Filed: Oct. 30, 2007

(65) Prior Publication Data

US 2009/0186020 A1    Jul. 23, 2009

Related U.S. Application Data

(63) Continuation-in-part of application No. 11/257,851, filed on Oct. 25, 2005, now abandoned, application No. 11/929,046.

(60) Provisional application No. 60/621,960, filed on Oct. 25, 2004, provisional application No. 60/972,018, filed on Sep. 13, 2007.

(51) Int. Cl.
*A61K 38/22* (2006.01)
*C07K 16/46* (2006.01)

(52) U.S. Cl. .................. 424/134.1; 530/300; 530/387.1; 512/2

(58) Field of Classification Search .................... None
See application file for complete search history.

(56) References Cited

U.S. PATENT DOCUMENTS

| | | | |
|---|---|---|---|
| 4,301,045 A | 11/1981 | Kaiser et al. |
| 4,415,546 A | 11/1983 | Ramachandran et al. |
| 4,457,864 A | 7/1984 | Hruby et al. |
| 4,485,039 A | 11/1984 | Hruby et al. |
| 4,649,191 A | 3/1987 | Hruby |
| 4,816,567 A | 3/1989 | Cabilly et al. |
| 4,866,038 A | 9/1989 | Hruby et al. |
| 4,918,055 A | 4/1990 | Hruby et al. |
| 5,028,592 A | 7/1991 | Lipton |
| 5,049,547 A | 9/1991 | Hruby et al. |
| 5,532,347 A | 7/1996 | Cone et al. |
| 5,622,860 A | 4/1997 | Yamada et al. |
| 5,674,839 A | 10/1997 | Hruby et al. |
| 5,683,981 A | 11/1997 | Hadley et al. |
| 5,703,220 A | 12/1997 | Yamada et al. |
| 5,714,576 A | 2/1998 | Hruby et al. |
| 5,731,408 A | 3/1998 | Hadley et al. |
| 5,824,307 A | 10/1998 | Johnson |

(Continued)

FOREIGN PATENT DOCUMENTS

EP    0 917 571 B1    12/2004

(Continued)

OTHER PUBLICATIONS

Aalberse et al., IgG4 breaking the rules, Immunol. 105:9-19, 105.*

(Continued)

*Primary Examiner* — Lorraine Spector
*Assistant Examiner* — Claire Kaufman
(74) *Attorney, Agent, or Firm* — Kirk Baumeister (57) ABSTRACT

Melanocortin receptor binding mimetibody polypeptides are disclosed. Polynucleotides encoding these polypeptides, cells comprising these polynucleotides or expressing the mimetibodies, and methods of making and using the forgoing are also disclosed.

5 Claims, 9 Drawing Sheets

V1 = N-terminal fragment of an antibody V region

Mp = melanocortin receptor binding peptide chain

Lk = flexible linker

V2 = C-terminal fragment of an antibody V region

Hg = Hinge of an antibody $C_H2$ = antibody $C_H2$ domain $C_H3$ = antibody $C_H3$ domain

U.S. PATENT DOCUMENTS

| | | | |
|---|---|---|---|
| 5,849,871 | A | 12/1998 | Cone et al. |
| 5,869,257 | A | 2/1999 | Yamada et al. |
| 5,877,154 | A | 3/1999 | Naveh |
| 5,891,847 | A | 4/1999 | Naveh |
| 5,908,609 | A | 6/1999 | Lee et al. |
| 6,100,048 | A | 8/2000 | Cone et al. |
| 6,117,975 | A | 9/2000 | Yamada et al. |
| 6,127,150 | A | 10/2000 | Coolidge et al. |
| 6,147,195 | A | 11/2000 | Scherz et al. |
| 6,203,995 | B1 | 3/2001 | Stark |
| 6,287,763 | B1 | 9/2001 | Lee et al. |
| 6,323,178 | B1 | 11/2001 | Hale et al. |
| 6,448,032 | B1 | 9/2002 | Wikberg et al. |
| 6,573,070 | B1 | 6/2003 | MacNeil et al. |
| 6,689,938 | B2 | 2/2004 | Brennan et al. |
| 6,716,810 | B1 | 4/2004 | Brennan et al. |
| 6,734,175 | B2 | 5/2004 | Hadcock et al. |
| 6,797,493 | B2 * | 9/2004 | Sun et al. |
| 6,894,028 | B2 | 5/2005 | Lipton et al. |
| 7,084,111 | B2 | 8/2006 | Haskell-Luevano |
| 7,241,733 | B2 | 7/2007 | Heavner et al. |
| 7,393,662 | B2 * | 7/2008 | Heavner et al. |
| 2003/0171295 | A1 | 9/2003 | Lee et al. |
| 2003/0229025 | A1 | 12/2003 | Xiao et al. |
| 2005/0038230 | A1 | 2/2005 | Sharma et al. |
| 2007/0135338 | A1 | 6/2007 | O'Neil et al. |
| 2009/0136505 | A1 * | 5/2009 | Bentz et al. |

FOREIGN PATENT DOCUMENTS

| | | |
|---|---|---|
| WO | WO 00/04873 A1 | 2/2000 |
| WO | WO 00/33658 A1 | 6/2000 |
| WO | WO 02/06316 A2 | 1/2002 |
| WO | WO 03/073056 A1 | 9/2003 |

OTHER PUBLICATIONS

Sawyer, et al., "[half-Cys$^4$, half-Cys$^{10}$]-α-Melanocyte-stimulating hormone: A cyclic α-melanotropin exhibiting superagonist biological activity," Proceeding of the National Academy of Science USA, 79: 1751-1755 (1982).

Dhillo, et al., "Hypothalamic peptides as drug targets for obesity," Current Opinion in Pharmacology, 1: 651-655 (2001).

Mountjoy, et al., "Agouti Antagonism of Melanocortin-4 Receptor: Greater Effect with Desacetyl-α-Melanocyte-Stimulating Hormone (MSH) than with α-MSH," Endocrinology, 140(5): 2167-2172 (1999).

Michaud, et al., "Obesity and the Adipocyte. Role of the *agouti* gene in obesity," Journal of Endocrinology, 155: 207-209 (1997).

Ollmann, et al., "Antagonism of Central Melanocortin Receptors in Vitro and in Vivo by Agouti-Related Protein," Science, 278: 135-138 (1997).

Fehm, et al., "The Melanocortin Melanocyte-Stimulating Hormone/Adresnocorticotropin$_{4-10}$ Decreases Body Fat in Humans," The Journal of Clinical Endocrinology & Metabolism, 86(3): 1144-1148 (2001).

Fan, et al., "Role of melanocortinergic neurons in feeding and the *agouti* obesity syndrome," Letters to Nature, 385: 165-168 (1997).

Lu, et al, "Agouti protein is an antagonist of the melanocyte-stimulating-hormone receptor," Letters to Nature, 371: 799-802 (1994).

Farooqi, et al., "Clinical Spectrum of Obesity and Mutations in the Melanocortin 4 Receptor Gene," The New England Journal of Medicine, 348(12): 1085-1095 (2003).

Froidevaux, et al., "A novel DOTA-alpha-melanocyte-stimulating hormone analog for metastatic melanoma diagnosis," Journal of Nuclear Medicine, 43(12): 1699-1706 (2002).

Haskell-Luevano, et al., "Truncation studies of alpha-melanotropin peptides identify tripeptide analogues exhibiting prolonged agonist bioactivity," Peptides, 17(6): 995-1002 (1996).

Supplemental EP Search Report dated Sep. 14, 2009 generated for Publication No. W02006/047535.

* cited by examiner

Fig. 1

V1 = N-terminal fragment of an antibody V region

Mp = melanocortin receptor binding peptide chain

Lk = flexible linker

V2 = C-terminal fragment of an antibody V region

Hg = Hinge of an antibody $C_H2$ = antibody $C_H2$ domain $C_H3$ = antibody $C_H3$ domain

SIGNAL SEQUENCE........................................................................................................................
Met Ala Trp Val Trp Thr Leu Leu Phe Leu Met Ala Ala Ala Gln
ATG GCT TGG GTG TGG ACC TTG CTA TTC CTG ATG GCG GCC GCC CAA

........................V1................alpha-MSH..............................................................
Ser Ile Gln Ala Gln Ile Gln Ser Tyr Ser Met Glu His Phe Arg
AGT ATA CAG GCC CAG ATC CAG TCC TAC TCC ATG GAG CAC TTC CGC ........................LINKER..............V$_H$........
Trp Gly Lys Pro Val Gly Ser Gly Gly Gly Ser Gly Thr Leu
TGG GGC AAG CCG GTG GGA TCC GGT GGA GGC TCC GGT ACC TTA ........................HINGE..............................
Val Thr Val Ser Ser Glu Pro Lys Ser Cys Asp Lys Thr His Thr
GTC ACC GTC TCC TCA GAG CCC AAA TCT TGT GAC AAA ACT CAC ACG ........................C$_H$2..............................
Cys Pro Pro Cys Pro Ala Pro Glu Leu Leu Gly Gly Pro Ser Val
TGC CCA CCG TGC CCA GCA CCT GAA CTC CTG GGG GGA CCG TCA GTC ........................................................
Phe Leu Phe Pro Pro Lys Pro Lys Asp Thr Leu Met Ile Ser Arg
TTC CTC TTC CCC CCA AAA CCC AAG GAC ACC CTC ATG ATC TCC CGG ........................................................
Thr Pro glu Val Thr Cys Val Val Val Asp Val Ser His Glu Asp
ACC CCT GAG GTC ACA TGC GTG GTG GTG GAC GTG AGC CAC GAA GAC ........................................................
Pro Glu Val Lys Phe Asn Trp Tyr Val Asp Gly Val Glu Val His
CCT GAG GTC AAG TTC AAC TGG TAC GTG GAC GGC GTG GAG GTG CAT ........................................................
Asn Ala Lys Thr Lys Pro Arg GLu Glu Gln Tyr Asn Ser Thr tyr
AAT GCC AAG ACA AAG CCG CGG GAG GAG CAG TAC AAC AGC ACG TAC ........................................................
Arg Val Val Ser Val Leu Thr Val Leu His Gln Asp Trp Leu Asn
CGG GTG GTC AGC GTC CTC ACC GTC CTG CAC CAG GAC TGG CTG AAT ........................................................
Gly Lys Glu Tyr Lys Cys Lys Val Ser Asn Lys Ala Leu Pro Ala

```
                GGC AAG GAG TAC AAG TGC AAG GTC TCC AAC AAA GCC CTC CCA GCC
FIG. 3-Cont.
```

```
............................................................................ C_H3 .........................
                Pro Ile Glu Lys Thr Ile Ser Lys Ala Lys Gly Gln Pro Arg Glu
                CCC ATC GAG AAA ACC ATC TCC AAA GCC AAA GGG CAG CCC CGA GAA
```

```
.................................................................................................................................
                Pro Gln Val Tyr Thr Leu Pro Pro Ser Arg Asp Glu Leu Thr Lys
                CCA CAG GTG TAC ACC CTG CCC CCA TCC CGG GAT GAG CTG ACC AAG
```

```
.................................................................................................................................
                Asn Gln Val Ser Leu Thr Cys Leu Val Lys Gly Phe Tyr Pro Ser
                AAC CAG GTC AGC CTG ACC TGC CTG GTC AAA GGC TTC TAT CCC AGC
```

```
.................................................................................................................................
                Asp Ile Ala Val Glu Trp Glu Ser Asn Gly Gln Pro Glu Asn Asn
                GAC ATC GCC GTG GAG TGG GAG AGC AAT GGG CAG CCG GAG AAC AAC
```

```
.................................................................................................................................
                Tyr Lys Thr Thr Pro Pro Val Leu Asp Ser Asp Gly Ser Phe Phe
                TAC AAG ACC ACG CCT CCC GTG CTG GAC TCC GAC GGC TCC TTC TTC
```

```
.................................................................................................................................
                Leu Tyr Ser Lys Leu Thr Val Asp Lys Ser Arg Trp Gln Gln Gly
                CTC TAC AGC AAG CTC ACC GTG GAC AAG AGC AGG TGG CAG CAG GGG
```

```
.................................................................................................................................
                Asn Val Phe Ser Cys Ser Val Met His Glu Ala Leu His Asn His
                AAC GTC TTC TCA TGC TCC GTG ATG CAT GAG GCT CTG CAC AAC CAC
```

```
..................................................................................................... STOP
                Tyr Thr Gln Lys Ser Leu Ser Leu Ser Pro Gly Lys
                TAC ACG CAG AAG AGC CTC TCC CTG TCT CCG GGT AAA TGA
```

MELANOCORTIN RECEPTOR BINDING MIMETIBODIES, COMPOSITIONS, METHODS AND USES

CROSS-REFERENCE TO RELATED APPLICATIONS

This application is a continuation-in-part of U.S. application Ser. No. 11/257,851, filed 25 Oct. 2005, now abandoned which claims priority to U.S. Provisional Application Ser. No. 60/621,960, filed 25 Oct. 2004. This application also claims the benefit of U.S. Provisional Application Ser. No. 60/972,018, filed 13 Sep. 2007. The entire contents of each of the aforementioned applications is incorporated herein by reference in their entirety.

FIELD OF THE INVENTION

The present invention relates to melanocortin receptor binding mimetibodies, polynucleotides encoding the mimetibodies, cells comprising the polynucleotides or expressing the mimetibodies, and methods of making and using the foregoing.

BACKGROUND OF THE INVENTION

Obesity is a chronic disease manifested by an excess of fat mass in proportion to body size. Today, every third American is considered overweight (Body Mass Index (BMI) >25 kg/m$^2$), thus prompting the United States Centers for Disease Control and Prevention (CDC) to declare that obesity is reaching epidemic proportions (Cummings and Schwartz, *Annu. Rev. Med.* 54:453-471 ((2003)). The importance of treating obesity is emphasized by the fact that this disease is either the underlying cause, or a risk factor, for developing diseases such as Type 2 Diabetes, congestive heart failure, osteoarthritis and sleep apnea among others.

Additionally, obesity is linked to "Metabolic Syndrome" which is a medical condition characterized by obesity, atherogenic dyslipidemia, elevated blood pressure and insulin resistance. Metabolic Syndrome affects an increasing number of people in the United States. Importantly, it has been shown that even a modest decrease in body weight (5-10% of initial body weight) may significantly improve Metabolic Syndrome conditions and decrease the risk factors for developing obesity-associated disease (Wing et al., *Arch. Intern. Med.* 147:1749-1753 (1987); Tuomilehto et al., *New Engl. J. Med.* 344:1343-1350 (2001); Knowler et al., *New Engl. J Med.* 346:393-403 (2002); Franz et al., *Diabetes Care* 25:148-198 (2002)). Additionally, treatment of obesity may be important from a mental health perspective due to the social stigma often attached to obese individuals in some cultures.

Melanocortin receptors play a major role in the regulation of overall energy balance and obesity in both humans and rodents. Alpha-melanocyte stimulating hormone (alpha-MSH) is a 13 amino acid peptide hormone that is an important component of the melanocortin system. Alpha-MSH is produced by the proteolytic processing of proopiomelanocortin (POMC) released by the pituitary gland. Alpha-MSH binds with high affinity to the melanocortin 4 receptor (MC4R), but also binds melanocortin receptor 3 (MC3R) and melanocortin receptor 5 (MC5R) with lower affinity. MC4R is a G-coupled protein receptor found in the brain which, when stimulated by alpha-MSH binding, causes decreased food intake and increased fat oxidation. Ultimately, stimulation of melanocortin receptors such as MC4R results in weight loss.

In humans and rodents, loss of function mutations in the different components of the melanocortin system are closely correlated with obesity and related conditions. In mice, mutations within POMC, or MC4R and MC3R produce obesity, insulin resistance and hyperphagia (Goodfellow and Saunders, *Curr. Topics Med. Chem.* 3: 855-883 (2003); Huszar et al., *Cell* 88:131-141 (1997); Yaswen et al., *Nat. Med.* 5: 1066-1070 (1999)). In man, mutations within POMC or MC4R lead to the development of obesity associated with increased food intake (Krude et al., *Nat. Genet.* 19:155-157 (1998); Yeo et al., *Nature Genetics* 20:111-112 (1998); Branson et al., *New Engl. J. Med.* 348: 1096-1103 (2003); Vaisse et al., *J. Clin. Invest.* 106):253-262 (2000); Ho and MacKenzie, *J. Biol. Chem.* 275: 35816-35822 (1999)).

Weight loss can result from the pharmacological stimulation of melanocortin system activity. In rodents pharmacological stimulation of melanocortin receptors such as MC4R leads to decreased food intake, increased energy expenditure and weight loss (Pierroz et al., *Diabetes* 51: 1337-1345 (2002)). In man, the intranasal administration of alpha-MSH to stimulate MC4R in non-obese men results in decreased body weight due to the loss of fat—but not lean body mass (Fehm et al., *J. Clin. Endo. Metabol.* 86: 1144-1148 (2001)).

Obesity is currently treated, with only limited success, by several different strategies. These strategies primarily involve "life-style" changes (e.g., diet and exercise), small molecule-based pharmaceutical therapies or surgical removal of a portion of the stomach (gastric by-pass surgery). Additionally, weight loss stimulating melanocortin receptor binding peptides such as alpha-MSH are of limited use as pharmaceuticals due to the extremely short serum half-life of such peptides.

Alpha-MSH also plays a role in enhancing male erectile activity. Targeting the melanocortin receptor with the synthetic melanocortin receptor activator molecule melanotan II (MTII) produced an unexpected side effect of enhancing erectile dysfunction (20). MTII has also been shown to initiate erections in rodents and humans without sexual stimulation in contrast to selective MC4 receptor agonists. Thus, both MC3 and MC4 receptors are likely necessary for complete proerectile erections. Clinical data showed a statistically significant erectile response in healthy male subjects following intranasal or subcutaneous administration of the MTII derivative, PT-141 (bremelanotide) (22, 23). Male erectile dysfunction (ED) is currently treated primarily with PDE5 inhibitors such as VIAGRA®, CIALIS® and LEVITRA®. However, these agents are required to be taken orally approximately one hour before sexual activity.

Bremelanotide is also being tested for use in treating female sexual dysfunction (FSD). The American Foundation for Urologic Disease defines FSD as: "The persistent or recurrent inability to attain or maintain sufficient sexual excitement, causing personal distress. It may be expressed as a lack of subjective excitement or a lack of genital or other somatic responses." FSD consists of four components, hypoactive sexual desire disorder, female sexual arousal disorder (FSAD), anorgasmia and dyspareunia. Some form of FSD appears to be prevalent in approximately 43 percent of the female population. Laumann et al., *JAMA* 281, 537-544 (1999).

Alpha-MSH also functions as a cytokine antagonist that inhibits inflammation caused by some of the most prominent mediators of local inflammation (31). For example, alpha-MSH inhibits production and action of proinflammatory cytokines and chemokines (32, 33). Alpha-MSH also inhibits macrophage production of cytotoxic nitric oxide (NO) and neopterin (34,35), prostaglandin E synthesis (37). Alpha- MSH also activates descending anti-inflammatory neural pathways dependent on peripheral beta 2-adrenergic receptors (38) and increases production of interleukin-10 (39).

In allergic inflammation, the anti-inflammatory effects of alpha-MSH peptides were confirmed in acute skin inflammation induced by nonspecific irritants and cytokines (42-46). In addition to its suppressive effect on induction and elicitation of contact hypersensitivity, alpha-MSH induces hapten-specific tolerance in mice through IL-10 release (47).

In gouty (acute) arthritis, ACTH had an anti-inflammatory effect in a rat model of gouty arthritis. The same authors also showed that targeting MC3R subtype could be useful for clinical management of human gouty arthritis and possibly other acute arthritis (48). In rheumatoid arthritis, treatment of rats, who had a preclinical adjuvant-induced rheumatoid arthritis, with alpha-MSH significantly reduced joint pathology. Effectiveness of alpha-MSH was reported to be similar to that of prednisolone.

In inflammatory bowel disease, alpha-MSH administered to mice with dextran sulfate-induced colitis had reduced fecal blood and less weight loss compared to mice receiving placebo (51). Alpha-MSH administration reduced colonic macroscopic lesions in both acute and chronic colitis induced by trinitrobenzosulfonic acid in rats (52).

In a mouse model of bilateral renal ischemia, alpha-MSH significantly reduced ischemia-induced renal damage (32).

In liver inflammation and fibrosis, alpha-MSH gene therapy reversed established liver fibrosis in CCl$_4$-treated mice (60). In another study, alpha-MSH inhibited systemic NO production, hepatic neutrophil infiltration and increased hepatic mRNA abundance for TNF-alpha and neutrophil and monocyte chemokines (33).

In ischemic brain damage (stroke), alpha-MSH treatment abolishes intracerebral proinflammatory cytokine gene expression after transient cerebral ischemia and indicates that systemically administered melanocortins may exert neuroprotective effects in cerebral ischemia. This study showed that alpha-MSH reduced activation of intracerebral TNF-alpha and IL1 beta gene expression after arterial occlusion and reperfusion (40). In another study, melanocortins provided strong protection, with a broad therapeutic window, against inflammatory, apoptotic (incl DNA damage), and histopathological and behavioral consequences of brain ischemia by activating CNS melanocortin 4 (MC4) receptors (41).

In peripheral neuropathies, alpha-MSH and ACTH demonstrated that both peptides stimulated axonal outgrowth from fetal spinal cord slices in vitro in a dose-dependent manner (53). Also, alpha-MSH promoted sprouting and neurite elongation from dissociated rat spinal and sensory neurons (55).

A need exists for additional treatments for the conditions discussed above and in particular for melanocortin receptor binding molecules with a potentially fast onset of action that overcome the short serum half-life of melanocortin receptor binding peptides such as alpha-MSH.

SUMMARY OF THE INVENTION

One aspect of the invention is a polypeptide according to formula (I):

$$(Mp\text{-}Lk\text{-}(V2)_y\text{-}Hg\text{—}C_H2\text{-}C_H3)_{(t)} \quad (I)$$

where Mp is a biologically active melanocortin receptor binding molecule fragment of SEQ ID NO: 87, 89, 91, 93, 95, 97, or 282, Lk is a polypeptide or chemical linkage, V2 is a portion of a C-terminus of an immunoglobulin variable region, Hg is at least a portion of an immunoglobulin variable hinge region, $C_H2$ is an immunoglobulin heavy chain $C_H2$ constant region and $C_H3$ is an immunoglobulin heavy chain $C_H3$ constant region, y is 0 or 1, and t is independently an integer from 1 to 10.

Another aspect of the invention is a polypeptide comprising a polypeptide having the sequence shown in SEQ ID NO: 121, 123, 127, 129, 132, 134, 137, 139, 142, 144, 147, 149, 152, 154, 157, 159, 162, 164, 167, 169, 172, 174, 177, 179, 182, 184, 187, 189, 192, 194, 197, 199, 202, 204, 207, 209, 212, 214, 217, 219, 222, 224, 227, 229, 232, 234, 237, 239, 242, 244, 251, 253, 256, 258, 261, 263, 266, or 268.

Another aspect of the invention is a polypeptide having the sequence shown in SEQ ID NO: 212.

Another aspect of the invention is a polynucleotide comprising a polynucleotide having the sequence shown in SEQ ID NO: 120, 122, 126, 128, 131, 133, 136, 138, 141, 143, 146, 148, 151, 153, 156, 158, 161, 163, 166, 168, 171, 173, 176, 178, 181, 183, 186, 188, 191, 193, 196, 198, 201, 203, 206, 208, 211, 213, 216, 218, 221, 223, 226, 228, 231, 233, 236, 238, 241, 243, 250, 252, 255, 257, 260, 262, 265, or 267 or a polynucleotide having a sequence complementary to the sequence shown in SEQ ID NO: 120, 122, 126, 128, 131, 133, 136, 138, 141, 143, 146, 148, 151, 153, 156, 158, 161, 163, 166, 168, 171, 173, 176, 178, 181, 183, 186, 188, 191, 193, 196, 198, 201, 203, 206, 208, 211, 213, 216, 218, 221, 223, 226, 228, 231, 233, 236, 238, 241, 243, 250, 252, 255, 257, 260, 262, 265, or 267.

Another aspect of the invention is a polynucleotide comprising a polynucleotide encoding the polypeptide having the sequence shown in SEQ ID NO: 121, 123, 127, 129, 132, 134, 137, 139, 142, 144, 147, 149, 152, 154, 157, 159, 162, 164, 167, 169, 172, 174, 177, 179, 182, 184, 187, 189, 192, 194, 197, 199, 202, 204, 207, 209, 212, 214, 217, 219, 222, 224, 227, 229, 232, 234, 237, 239, 242, 244, 251, 253, 256, 258, 261, 263, 266, or 268.

Another aspect of the invention is a pharmaceutical composition comprising a mimetibody composition of the invention.

Another aspect of the invention is a method of modifying the biological activity of a melanocortin receptor in a cell, tissue or organ, comprising contacting a mimetibody composition of the invention with the cell, tissue or organ.

Another aspect of the invention is a method of modulating at least one melanocortin receptor mediated condition comprising administering a mimetibody composition of the invention to a patient in need thereof.

DETAILED DESCRIPTION OF THE INVENTION

All publications, including but not limited to patents and patent applications, cited in this specification are herein incorporated by reference as though fully set forth.

The present invention provides polypeptides having the properties of binding a melanocortin receptor and mimicking different isotypes of antibody immunoglobulin molecules such as IgA, IgD, IgE, IgG, or IgM, and any subclass thereof, such as $IgA_1$, $IgA_2$, $IgG_1$, $IgG_2$, $IgG_3$ or $IgG_4$, or combinations thereof, herein after generally referred to as "mimetibodies." In some embodiments, the mimetibody polypeptides of the invention contain an alpha melanocyte stimulating hormone peptide (alpha-MSH) sequence and are designated melanocortin receptor binding alpha-MSH mimetibody. Such alpha-MSH mimetibody polypeptides can bind melanocortin receptor 4 (MC4R) and MCR5 with equal affinity and MC5R with lower affinity. One result of such melanocortin receptor binding can be the stimulation or inhibition of melanocortin receptor activity. Stimulation or inhibition of melanocortin receptor activity can be useful for treatment of melanocortin receptor mediated conditions.

In one embodiment, the polypeptides of the invention have the generic formula (I):

$$(Mp\text{-}Lk\text{-}(V2)_y\text{-}Hg\text{—}C_H2\text{-}C_H3)_{(t)} \quad (I)$$

where Mp is a melanocortin receptor binding molecule, Lk is a polypeptide or chemical linkage, V2 is a portion of a C-terminus of an immunoglobulin variable region, Hg is at least a portion of an immunoglobulin variable hinge region, $C_H2$ is an immunoglobulin heavy chain $C_H2$ constant region and $C_H3$ is an immunoglobulin heavy chain $C_H3$ constant region, y is 0 or 1, and t is independently an integer of 1 to 10.

As used herein, "melanocortin receptor binding molecule" means a molecule, which can bind at least one melanocortin receptor such as *Homo sapiens* MC4R (SEQ ID NO: 77). Examples of other *Homo sapiens* melanocortin receptors include MCR1 (SEQ ID NO: 71), MCR2 (SEQ ID NO: 73), MCR3 (SEQ ID NO: 75), and MCR5 (SEQ ID NO: 79). A given peptide chain is a "melanocortin receptor" if it has at least 85% amino acid sequence identity to a known melanocortin receptor sequence or the mature form of a known melanocortin receptor and can function as a G-protein coupled receptor. Percent identity between two peptide chains can be determined by pairwise alignment using the default settings of the AlignX module of Vector NTI v.9.0.0 (Invitrogen Corp., Carlsbad, Calif.). An exemplary melanocortin receptor binding molecule is the 13 amino acid alpha-MSH peptide having the amino acid sequence shown in SEQ ID NO: 2. Other melanocortin receptor binding molecules include biologically active fragments of SEQ ID NO: 2 and other amino acid sequences that can bind a melanocortin receptor. The term "biologically active fragment" as used herein, refers to a portion of an alpha-MSH peptide that can bind to a melanocortin receptor such as MC4R. The peptide sequence HFRW (SEQ. ID. NO. 81) is an exemplary "biologically active fragment" of the alpha-MSH peptide sequence SYSMEHFRWGKPV (SEQ ID NO: 2). The HFRW fragment has been incorporated into the structure of the synthetic melanocortin receptor activator molecule melanotan II (MTII) (Fan et al., *Nature* 385: 165-168 (1997)).

Incorporation of melanocortin receptor binding molecules in the mimetibody polypeptides of the invention provides for binding to melanocortin receptors with a wide range of affinities. The mimetibody polypeptides of the invention may bind a melanocortin receptor with a $K_d$ less than or equal to about $10^{-7}$, $10^{-8}$, $10^{-9}$, $10^{-10}$, $10^{-11}$ or $10^{-12}$ M. The range of obtained $IC_{50}$ values for aMSH peptide, MTII peptide and aMSH mimetibody were 260-400 nM, 5-30 nM and 200-300 nM, respectively. The affinity of a mimetibody polypeptide for a melanocortin receptor can be determined experimentally using any suitable method. Such methods may utilize Biacore or KinExA instrumentation, ELISA or competitive binding assays. Mimetibody polypeptides binding specific melanocortin receptors with a desired affinity can be selected from libraries of variants or fragments by techniques known to those skilled in the art.

An alpha-MSH peptide having the amino acid sequence shown in SEQ ID NO: 2 may be modified to obtain other melanocortin receptor binding molecules. Such modifications may comprise the incorporation of C—$[X]_n$—C motifs into the peptide to conformationally constrain the peptide through the formation of disulfide bonds. In a C—$[X]_n$—C motif, C is a cysteine residue, X is a amino acid residues and n is an integer necessary to achieve the required conformational constraint. In this instance n can be as little as 1 residue and as high as 50. Exemplary C—$[X]_n$—C modified peptide sequences are shown in SEQ ID NOs: 4, 6, 8, 10, 89, 91, 93, 95, and 97. The C—$[X]_n$—C modified peptide sequences can be further modified, if necessary, to prevent N-terminal clipping of mature mimetibodies. For example, SEQ ID NO: 4 or SEQ ID NO: 97 can be modified to remove the N-terminal S—Y—S sequence and replace it with G-G as shown in SEQ ID NO: 282 or SEQ ID NO: 271, respectively.

The modification may also comprise the incorporation of a Wa-$[X]_n$-Wa motif into the peptide to conformationally constrain the peptide through the formation of a tryptophan zipper. In a Wa-$[X]_n$-Wa motif W is tryptophan residue, X is an amino acid, a is an integer usually 2, but can be from 1 to 10, and n is an integer necessary to achieve the required conformational constraint. In this instance n can be as little a 1 residue and as high as 50. Exemplary Wa-$[X]_n$-Wa peptides are shown in SEQ ID NOs: 12, 14, 16 and 18. Further, the sequence HFRW (SEQ ID NO: 81) present in the alpha-MSH peptide may also be modified by substituting any residue in this sequence with any one of F, H, W and M; for example, HFRW (SEQ ID NO: 81) can be substituted to FHWM (SEQ ID NO: 83).

In the polypeptides of the invention, the linker portion (Lk) provides structural flexibility by allowing the mimetibody to have alternative orientations and binding properties. Exemplary linkers include non-peptide chemical linkages or one to 20 amino acids linked by peptide bonds, wherein the amino acids are selected from the 20 naturally occurring amino acids or other amino acids (e.g. D-amino acids, non-naturally occurring amino acids, or rare naturally occurring amino acids). The linker portion can include a majority of amino acids that are sterically unhindered, such as glycine, alanine and serine and can include GS, poly GS (e.g. GSGS (SEQ ID NO: 20)), GGSG (SEQ ID NO: 22), GSGGGS (SEQ ID NO: 24), GSGGGSG (SEQ ID NO: 26), GSSG (SEQ ID NO: 28), GGGS (SEQ ID NO: 85), GGGGS (SEQ ID NO: 99), GGGGSGGGGS (SEQ ID NO: 101), GGGGSGGGGSGGGGS (SEQ ID NO: 103), GGGGSGGGGSGGGGSGGGGS (SEQ ID NO: 105) or any combination or polymer thereof. Other exemplary linkers within the scope of the invention may be longer than 20 residues and may include residues other than glycine, alanine and serine.

In the polypeptides of the invention, V2 is a portion of a carboxy terminal domain of an immunoglobulin variable region such as a heavy chain variable region. Exemplary V2 amino acid sequences are GTLVTVSS (SEQ ID NO: 32), TLVAVSS (SEQ ID NO: 34), and TLVTVSS (SEQ ID NO: 249).

The (Mp-Lk-(V2)$_y$-Hg—C$_H$2-C$_H$3)$_{(t)}$ mimetibody polypeptides of the invention may comprise "y" V2 polypeptides where y is 0 (zero) or 1 (one). The amino acid sequences shown in SEQ ID NOs: 127, 129, 132, 134, 137, 139, 142, 144, 202, 204, 207, 209, 212, 214, 217, 219, 222, 224, 227, 229, 256, 259, 261, 264, 266, or 269 are exemplary of mimetibody polypeptides comprising one V2 polypeptide. Stated differently, these mimetibody polypeptides are examples of the formula (Mp-Lk-(V2)$_y$-Hg—C$_H$2-C$_H$3)$_{(t)}$ where y is one. The amino acid sequences in SEQ ID NOs: 60, 62, 121, 123, 147, 149, 152, 154, 157, 159, 162, 164, 172, 174, 177, 179, 182, 184, 187, 189, 192, 194, 197, 199, 232, 234, 237, 239, 242, 244, 251, or 253 are exemplary of mimetibody polypeptides that lack a V2 polypeptide. In other words, these are mimetibody polypeptides of the formula (Mp-Lk-(V2)$_y$-Hg—C$_H$2-C$_H$3)$_{(t)}$.

In the polypeptides of the invention, Hg is a portion of the hinge domain of an immunoglobulin variable region such as a heavy chain variable region. Exemplary Hg amino acid sequences include EPKSCDKTHTCPPCP (SEQ ID NO: 36), EPKSADKTHTCPPCP (SEQ ID NO: 38), ESKYGPPCPSCP (SEQ ID NO: 40), ESKYGPPCPPCP (SEQ ID NO: 42), CPPCP (SEQ ID NO: 44) and CPSC (SEQ ID NO: 46).

Hg amino acid sequences can be modified. Such modifications can remove potential sites of O-linked glycosylation. Such modifications can also remove cysteine residues that may cause aggregates or multimers of the polypeptides of the invention to form.

One way to minimize O-linked glycosylation in the mimetibodies of the invention is to substitute Ala residues for Thr residues in the Hg portion of the polypeptides of the invention. The Hg amino acid sequence EPKSCDKTHACPPCP (SEQ ID NO: 107) is exemplary of such a Thr to Ala substitution; this particular Hg substitution can also be obtained by a Thr to Ala substitution at position 59 of SEQ ID NO: 62.

One way to minimize aggregation or multimerization of the mimetibodies of the invention is to substitute Ala residues for Cys residues in the Hg portion of the polypeptides of the invention. The Hg amino acid sequence EPKSADKTHTCPPCP (SEQ ID NO: 109) is exemplary of such a Cys to Ala substitution; this particular Hg substitution can also be obtained by a Cys to Ala substitution at position 54 of SEQ ID NO: 62.

Modifications to the Hg amino acid sequences of the mimetibody polypeptides of the invention can be made singly or in combination. The Hg amino acid sequence EPKSADKTHACPPCP (SEQ ID NO: 111) combines both the aforementioned substitutions; and can be obtained by a Cys to Ala substitution at position 54 and a Thr to Ala substitution at position 59 of SEQ ID NO: 62. Those skilled in the art will recognize other amino acid residues that can be used to make substitutions that remove O-glycosylation sites and aggregation or multimerization associated sites in the mimetibodies of the invention. Such sites can also be deleted by removing amino acid residues.

In the polypeptides of the invention, C$_H$2 is an immunoglobulin heavy chain C$_H$2 constant region. Exemplary C$_H$2 amino acid sequences include:

(SEQ ID NO: 48)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAK, (SEQ ID NO: 50)
APEAAGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTTSKAK, (SEQ ID NO: 52)
APEFLGGPSVFLFPPKPKDTLMISRTPEVTCVVVDVSQEDPEVQFNWYVD
GVEVHNAKTKPREEQFNSTYRVVSVLTVLHQDWLNGKEYKCKVSNKGLPS
SIEKTTSKAK, (SEQ ID NO: 54)
APEAAGGPSVFLFPPKPKDTLMISRTPEVTCVVVDVSQEDPEVQFNWYVD
GVEVHNAKTKPREEQFNSTYRVVSVLTVLHQDWLNGKEYKCKVSNKGLPS
SIEKTISKAK, (SEQ ID NO: 117)
APEAAGGPSVFLFPPKPKDTLMISRTPEVTCVVVDVSQEDPEVQFNWYVD
GVEVHNAKTKPREEQFNSTYRVVSVLTVLHQDWLNGKEYKCKVSNKGLSS
PIEKTISKAK,
and (SEQ ID NO: 246)
APEAAGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAK.

In the polypeptides of the invention, C$_H$3 is an immunoglobulin heavy chain C$_H$3 constant region. Exemplary C$_H$3 amino acid sequences include: GQPREPQVYTLPPSRDELTKNQVSLT-CLVKGFYPSDIAVEWESNGQPENNYKT-TPPVLDSDGSFFLYS KLTVDKSRWQQGNVFSCSVM-HEALHNHYTQKSLSLSPGK (SEQ ID NO: 56), GQPREPQVYTLPPSQEEMTKNQVSLT-CLVKGFYPSDIAVEWESNGQPENNYKT-TPPVLDSDGSFFLYS RLTVDKSRWQEGNVFSCSVM-HEALHNHYTQKSLSLSLGK (SEQ ID NO: 58), and GQPREPQVYTLPPSREEMTKNQVSLT-CLVKGFYPSDIAVEWESNGQPENNYKT-TPPVLDSDGSFFLYS RLTVDKSRWQEGNVFSCSVM-HEALHNHYTQKSLSLSLGK (SEQ ID NO: 119). It will be recognized by those skilled in the art that the C$_H$3 region of the polypeptides of the invention may have its C-terminal amino acid cleaved off when expressed in certain recombinant systems.

In the mimetibody polypeptides of invention Hg, C$_H$2 or C$_H$3 may be of the IgG$_1$ or IgG$_4$ subclass. A sequence is of the IgG$_1$ or IgG$_4$ subclass if it is formed or developed from a γ1 or γ4 heavy chain respectively. A given peptide chain is a γ1 or γ4 heavy chain if it is at least 80% identical to a known γ1 or γ4 heavy chain sequence of a given species. Percent identity between two peptide chains can be determined by pairwise alignment using the default settings of the AlignX module of Vector NTI v.9.0.0 (Invitrogen Corp., Carlsbad, Calif.).

In the mimetibody polypeptides of the invention Hg, C$_H$2 or C$_H$3 may individually be of the IgG$_1$ or IgG$_4$ subclass. The mimetibodies of the invention may also comprise combinations of Hg, C$_H$2 or C$_H$3 elements from each subclass For example, Hg may be of the IgG$_4$ subclass while C$_H$2 and C$_H$3 are of the IgG$_1$ subclass. Alternatively, Hg, C$_H$2 and C$_H$3 may all of the IgG$_4$ or IgG$_1$ subclass. The polypeptide EPKSCDKTHTCPPCPAPELLGGPSVFLFPPKP-KDTLMISRTPEVTCVVVDVSHEDPEVK-FNWYVDGVE VHNAKTKPREEQYNSTYRVVSVLTVL-HQDWLNGKEYKCKVSNKALPAPIEK-TISKAKGQPREPQVYTL PPSRDELTKNQVSLT- CLVKGFYPSDIAVEWESNGQPENNYKTTPPVLDSDG-
SFFLYSKLTVDKSRWQQ
GNVFSCSVMHEALHNHYTQKSLSLSPGK (SEQ ID
NO: 65) is exemplary of a polypeptide in which Hg (residues
1-15 of SEQ ID NO: 65), $C_H2$ (residues 16-125 of SEQ ID
NO: 65), and $C_H3$ (residues 126-232 of SEQ ID NO: 65) are
all of the $IgG_1$ subclass.

The $IgG_1$ and $IgG_4$ subclasses differ in the number of cysteines in the hinge region. Most IgG type antibodies, such as $IgG_1$, are homodimeric molecules made up of two identical heavy (H) chains and two identical light (L) chains, typically abbreviated $H_2L_2$. Thus, these molecules are generally bivalent with respect to antigen binding due to the formation of inter-heavy chain disulfide bonds and both antigen binding (Fab) arms of the IgG molecule have identical binding specificity. $IgG_4$ isotype heavy chains, in contrast, contain a CPSC (SEQ ID NO: 46) motif in their hinge regions capable of forming either inter- or intra-heavy chain disulfide bonds, i.e., the two Cys residues in the CPSC motif may disulfide bond with the corresponding Cys residues in the other H chain (inter) or the two Cys residues within a given CPSC motif may disulfide bond with each other (intra). Since the HL pairs in those $IgG_4$ molecules with intra-heavy chain bonds in the hinge region are not covalently associated with each other, they may dissociate into HL monomers that then reassociate with HL monomers derived from other $IgG_4$ molecules forming bispecific, heterodimeric $IgG_4$ molecules. In vivo isomerase enzymes may facilitate this process. In a bispecific IgG antibody the two Fab "arms" of the antibody molecule differ in the epitopes that they bind. Substituting Ser residues in the hinge region of $IgG_4$ with Pro results in "$IgG_1$-like behavior," i.e., the molecules form stable disulfide bonds between heavy chains and therefore, are not susceptible to HL exchange with other $IgG_4$ molecules.

The mimetibody polypeptides of the invention may be made more $IgG_4$-like, or $IgG_1$-like by the modification of sites which are involved in disulfide bond formation and are present in the Hg—$C_H2$-$C_H3$ portion of the mimetibody polypeptides. Such sites may be modified by removal, deletion, insertion or substitution with other amino acids. Typically, the cysteine residues present in disulfide bond associated motifs are removed or substituted. Removal of these sites may avoid covalent disulfide bonding with other cysteine-containing proteins present in the mimetibody producing host cell or intra-heavy chain disulfide bonding in $IgG_4$-based constructs while still allowing for noncovalent dimerization of mimetibody Hg—$C_H2$-$C_H3$ domains. Modification of such sites can permit the formation of bispecific mimetibody polypeptides with two different Mp portions or prevent the formation of such bispecific species.

The $IgG_1$ and $IgG_4$ subclasses also differ in their ability to mediate complement dependent cytotoxicity (CDC) and antibody-dependent cellular cytotoxicity (ADCC). CDC is the lysing of a target cell in the presence of complement. The complement activation pathway is initiated by the binding of the first component of the complement system (Clq) to a molecule complexed with a cognate antigen. $IgG_1$ is a strong inducer of the complement cascade and subsequent CDC activity, while $IgG_4$ has little complement-inducing activity. ADCC is a cell-mediated process in which nonspecific cytotoxic cells that express Fc receptors (FcRs) involved in ADCC (e.g., natural killer (NK) cells, neutrophils, and macrophages) recognize bound antibody on a target cell and subsequently cause lysis of the target cell. The $IgG_1$ subclass binds with high affinity to Fc receptors involved in ADCC and contributes to ADCC, while $IgG_4$ binds only weakly to such receptors and has little ADCC inducing activity. The relative inability of $IgG_4$ to activate effector functions such as ADCC is desirable since delivery of the mimetibody polypeptide to cells without cell killing is possible.

The CDC and ADCC activity of the mimetibody polypeptides of the invention may be modified by altering sites involved in CDC and ADCC present in the Hg—$C_H2$-$C_H3$ portion of the mimetibody polypeptide. Such sites may be modified by removal, deletion, insertion or substitution with other amino acids. In the mimetibodies of the invention sites involved in CDC, such as the Clq binding site, are typically removed or otherwise modified to minimize CDC activity. Additionally, Fc receptor binding sites involved in ADCC can also be similarly modified in the mimetibodies of the invention. In general, such modification will remove Fc receptor binding sites involved in ADCC activity from the mimetibodies of the invention. The substitution of Leu residues with Ala residues in the $C_H2$ portion of the polypeptides of the invention is one example of a modification which can minimize ADCC activity in the polypeptides of the invention. The $C_H2$ amino acid sequences APEAAGGPSVFLFPPKP-KDTLMISRTPEVTCVVVDVSHEDPEVK-FNWYVDGVEVHNAKTKPREEQYNS TYRVVSVLTV-LHQDWLNGKEYKCKVSNKALPAPIEKTISKAK (SEQ ID NO: 52) and APEAAGGPSVFLFPPKPKDTLMISRTPE-VTCVVVDVSQEDPEVQFNWYVDGVEVH-NAKTKPREEQFNS TYRVVSVLTVLHQDWL-NGKEYKCKVSNKGLSSPIEKTISKAK (SEQ ID NO: 54) are exemplary of such a Leu to Ala substitution at residues 4 and 5 (in these sequences). Further, the V1 domain can be removed such that the N-terminus of the peptide is free following cleavage of the signal peptide, and is accessible to and could be modified by enzymes such as acetylases.

Antibodies of both the $IgG_4$ and $IgG_1$ isotypes contain FcRn salvage receptor binding sites. The FcRn salvage receptor helps maintain IgG antibody levels in the body by recycling or transporting IgG type antibodies across enodothelial cell layers such as those lining the inside of body cavities and blood vessels. The FcRn salavage receptor does this by binding IgGs that have entered endothelial cells by nonspecific pinocytosis and preventing these IgG antibody molecules from being degraded in the lysosome of the cell. The result of such FcRn receptor activity is that the serum half-life of a molecule with an FcRn binding site is extended relative to an otherwise identical molecule lacking such a site.

Exemplary mature mimetibody polypeptides of the invention including a Ser to Pro substitution in the hinge region and $C_H2$ domain Leu to Ala substitutions on an $IgG_4$ backbone have the nucleic and amino acid sequences shown in SEQ ID NOs: 211-215 and 250-254. In particular, SEQ ID NOs: 212 and 214 show the amino acid sequence of a mimetibody polypeptide having an Mp sequence as shown in SEQ ID NO: 4 and an Lk sequence as shown in SEQ ID NO: 101 without and with a signal sequence, respectively. SEQ ID NOs: 211 and 213 show exemplary nucleic acid sequences encoding these polypeptides. Further, SEQ ID NOs: 251 and 253 show the amino acid sequence of a mimetibody polypeptide having an Mp sequence as shown in SEQ ID NO: 282 and an Lk sequence as shown in SEQ ID NO: 101 without and with a signal sequence, respectively. SEQ ID NOs: 250 and 252 show exemplary nucleic acid sequences encoding these polypeptides.

It is desirable that the Hg—$C_H2$-$C_H3$ portion of the mimetibodies of the invention contain a FcRn binding site at the junction of the $C_H2$ and $C_H3$ regions. It is expected that such FcRn sites will increase the serum half-life of the mimetibodies of the invention as well as improve other pharmacokinetic properties relative to a melanocortin receptor binding molecule, such as alpha-MSH alone. In the mimetibodies of the invention FcRn sites may be modified or added by removal, deletion, insertion or substitution of amino acids. Typically, such modifications are used to improve the binding of a given site to the FcRn. One example of a human FcRn binding sites is the sequence MISRTPTVLHQHNHY (SEQ. ID. NO.: 69) found in both IgG$_1$ and IgG$_4$ antibodies. Other FcRn binding sites are well known by those skilled in the art.

Antibodies with different isotypes, such as IgG$_4$ and IgG$_1$, may contain glycosylation sites. Glycosylation of these sites can alter the properties and activities of antibody molecules. Antibody molecules may be N-glycosylated or O-glycosylated. N-glycosylation of antibody amino acid residue side chains containing nitrogen atoms (e.g., Asn) can modulate antibody Fc effector functions such as ADCC by conferring a cytolytic activity to N-glycosylated antibody molecules. This ADCC associated cytolytic activity causes the lysis of cells effected by such N-glycosylated antibodies. Alternatively, an antibody molecule may be O-glycosylated by modification of amino acid residue side chains containing oxygen atoms (e.g., Ser or Thr). O-glycosylation can decrease the serum half-life of an antibody molecule through increased lectin mediated clearance of O-glycosylated antibody molecules from the serum. Additionally, O-glycosylation can cause undesirable increases in antibody heterogeneity due to differing extents of O-glycosylation between various antibody molecules. Lastly, both O-glycosylation and N-glycosylation can alter the structure dependent properties of antibody molecules such as binding affinity and immunogenicity.

Like the antibody molecules they mimic, the mimetibody polypeptides of the invention may also be post-translationally modified by N-glycosylation and O-glycosylation. In most instances, it is desirable to limit the N-glycosylation of the mimetibodies of the invention to minimize cytolytic activity. N-glycosylation can be limited by the removal or substitution of amino acid residues, such as Asn, which are typically N-glycosylated. It is also desirable to limit mimetibody O-glycosylation to minimize lectin-mediated clearance, mimetibody heterogeneity and the alteration of structure dependent mimetibody properties such as binding affinity and immunogenicity. One way to minimize O-linked glycosylation in the mimetibodies of the invention is to substitute Ala residues for Thr residues in the V2 portion of the polypeptides of the invention. The V2 amino acid sequence TLVAVSS (SEQ ID NO: 34) is exemplary of such a Thr to Ala substitution; this particular V2 substitution can also be obtained by a Thr to Ala substitution at position 47 of SEQ ID NO: 62. Those skilled in the art also will recognize other ways to control N-linked and O-linked glycosylation including modulation of glycosylase enzyme activity.

The monomeric structure Mp-Lk-(V2)$_y$-Hg—C$_H$2-C$_H$3 of the mimetibody polypeptides of the invention can be linked to "t" other monomers where t is an integer from 1 to 10. Such linking can occur through non-covalent interactions or covalent linkages such as a Cys-Cys disulfide bond. In this way multimeric structures such as dimers and higher order multimers of the polypeptides of the invention can be formed. It is expected that dimerization of the polypeptides of the invention will increase the affinity of these polypeptides to melanocortin receptors such as MC4R. The term "multimers" as used herein means molecules that have quaternary structure and are formed by the association of two or more subunits.

The polypeptides of the invention can optionally comprise at the amino terminus, an amino terminal portion of an immunoglobulin variable region, designated V1 as shown in Formula II:

$$(\text{V1-Mp-Lk-(V2)}_y\text{-Hg—C}_H2\text{-C}_H3)_{(t)} \tag{II}$$

Exemplary V1 amino acid sequences include QIQ, QVQ, QIQGG (SEQ ID NO: 113), and QIQGGGG (SEQ ID NO: 115).

The polypeptides of the invention may also comprise secretory signals necessary to facilitate protein secretion or other signals necessary for protein trafficking in the cell. An exemplary secretory signal sequence is MAWVWTLLFL-MAAAQSIQA (SEQ ID NO: 69). Those skilled in the art will recognize other secretory signals.

In one embodiment the polypeptides of the invention comprise polypeptides having the sequences shown in SEQ ID NO: 60, 62, 121, 123, 127, 129, 132, 134, 137, 139, 142, 144, 147, 149, 152, 154, 157, 159, 162, 164, 167, 169, 172, 174, 177, 179, 182, 184, 187, 189, 192, 194, 197, 199, 202, 204, 207, 209, 212, 214, 217, 219, 222, 224, 227, 229, 232, 234, 237, 239, 242, 244, 251, 253, 256, 258, 261, 263, 266, or 268. These sequences exemplify melanocortin receptor binding alpha-MSH polypeptides either having, or lacking, an amino terminal secretory signal sequence. SEQ ID NO: 62 represents a (V1-Mp-Lk-(V2)$_y$-Hg—C$_H$2-C$_H$3)$_{(t)}$ melanocortin receptor binding alpha-MSH polypeptide of generic formula (II) which has the secretory signal MAWVWTLLFL-MAAAQSIQA (SEQ ID NO: 69) fused to its amino terminus. SEQ ID NO: 60 represents a (Mp-Lk-(V2)$_y$-Hg—C$_H$2-C$_H$3)$_{(t)}$ melanocortin receptor binding alpha-MSH polypeptide of generic formula (I). No secretory signal is present in SEQ ID NO: 60.

Another aspect of the present invention is a polynucleotide comprising, complementary to or having significant identity with, a polynucleotide encoding at least one melanocortin receptor binding mimetibody. Other aspects of the present invention include vectors comprising at least one polynucleotide molecule encoding a melanocortin receptor binding mimetibody. In a different aspect the invention provides a cell comprising a vector of the invention or a cell expressing a mimetibody polypeptide of the invention. The polynucleotides, vectors and cells may be used to produce the mimetibody polypeptides of the invention.

In one embodiment, the polynucleotides of the invention comprise a polynucleotide having the sequence shown in SEQ ID NO: 59, 61, 120, 122, 126, 128, 131, 133, 136, 138, 141, 143, 146, 148, 151, 153, 156, 158, 161, 163, 166, 168, 171, 173, 176, 178, 181, 183, 186, 188, 191, 193, 196, 198, 201, 203, 206, 208, 211, 213, 216, 218, 221, 223, 226, 228, 231, 233, 236, 238, 241, 243, 250, 252, 255, 257, 260, 262, 265, or 267 or a polynucleotide having a sequence complementary to the sequence shown in SEQ ID NO: 59, 61, 120, 122, 126, 128, 131, 133, 136, 138, 141, 143, 146, 148, 151, 153, 156, 158, 161, 163, 166, 168, 171, 173, 176, 178, 181, 183, 186, 188, 191, 193, 196, 198, 201, 203, 206, 208, 211, 213, 216, 218, 221, 223, 226, 228, 231, 233, 236, 238, 241, 243, 250, 252, 255, 257, 260, 262, 265, or 267. SEQ ID NO: 59 is a cDNA encoding a (Mp-Lk-(V2)$_y$-Hg—C$_H$2-C$_H$3)$_{(t)}$ melanocortin receptor binding alpha-MSH polypeptide of generic formula (I) which lacks a signal sequence. SEQ ID NO: 61 is a cDNA encoding a (V1-Mp-Lk-(V2)$_y$-Hg—C$_H$2-C$_H$3)$_{(t)}$ melanocortin receptor binding alpha-MSH polypeptide of generic formula (II) which has a secretory signal fused to its amino terminus.

In one embodiment, the polynucleotides of the invention comprise a polynucleotide encoding the polypeptide having the sequence shown in SEQ ID NO: 60, 62, 121, 123, 127, 129, 132, 134, 137, 139, 142, 144, 147, 149, 152, 154, 157, 159, 162, 164, 167, 169, 172, 174, 177, 179, 182, 184, 187, 189, 192, 194, 197, 199, 202, 204, 207, 209, 212, 214, 217, 219, 222, 224, 227, 229, 232, 234, 237, 239, 242, 244, 251, 253, 256, 258, 261, 263, 266, or 268. Exemplary nucleic acid sequences that encode the polypeptide sequences shown in SEQ ID NO 60, 62, 121, 123, 127, 129, 132, 134, 137, 139, 142, 144, 147, 149, 152, 154, 157, 159, 162, 164, 167, 169, 172, 174, 177, 179, 182, 184, 187, 189, 192, 194, 197, 199, 202, 204, 207, 209, 212, 214, 217, 219, 222, 224, 227, 229, 232, 234, 237, 239, 242, 244, 251, 253, 256, 258, 261, 263, 266, or 268 are shown in SEQ ID NO: 59, 61, 120, 122, 126, 128, 131, 133, 136, 138, 141, 143, 146, 148, 151, 153, 156, 158, 161, 163, 166, 168, 171, 173, 176, 178, 181, 183, 186, 188, 191, 193, 196, 198, 201, 203, 206, 208, 211, 213, 216, 218, 221, 223, 226, 228, 231, 233, 236, 238, 241, 243, 250, 252, 255, 257, 260, 262, 265, or 267, respectively.

Also provided are polynucleotides encoding polypeptides that are substantially identical to the polypeptides of the invention. The term "substantially identical" in the context of polypeptides means that a given polypeptide sequence is identical to a polypeptide sequence of the invention, in particular the V1-Mp-Lk-V2-Hg region, in at least 50% or at least about 60% or at least about 70% or at least about 80% or at least about 90% or at least about 95-98% of the amino acid residues. Percent identity between two polypeptide sequences can be determined by pairwise alignment using the default settings of the AlignX module of Vector NTI v.9.0.0 (Invitrogen Corp., Carlsbad, Calif.). Those skilled in the art would recognize polynucleotide sequences which would encode the above-described polypeptides.

Typically, the polynucleotides of the invention are used in expression vectors for the preparation of the mimetibody polypeptides of the invention. Vectors within the scope of the invention provide necessary elements for eukaryotic expression and include viral promoter driven vectors, such as CMV promoter driven vectors, e.g., pcDNA3.1, pCEP4, and their derivatives, Baculovirus expression vectors, Drosophila expression vectors, and expression vectors that are driven by mammalian gene promoters, such as human Ig gene promoters. Other examples include prokaryotic expression vectors, such as T7 promoter driven vectors, e.g. pET41, lactose promoter driven vectors and arabinose gene promoter driven vectors.

The present invention also relates to a cell that expresses a mimetibody of the invention or comprises a vector of the invention. Open reading frames encoding the mimetibody polypeptides of the invention can be identified by translation of the positive strand reading frame beginning with nucleotide residue 1601 of SEQ ID NOs: 63, 125, 130, 135, 140, 145, 150, 155, 160, 165, 170, 175, 180, 185, 190, 195, 200, 205, 210, 215, 220, 225, 230, 235, 240, 245, 254, 259, 264, or 269. The various signal peptide, V1, Mp, V2, Hg, $C_H2$, and $C_H3$ portions of the mimetibody polypeptides of the invention, which have been exemplified herein, are also present in these open reading frames and can be identified using standard sequence analysis methods, such as multiple sequence alignment or other methods well know in the art. Such a cell can be prokaryotic or eukaryotic. Exemplary eukaryotic cells are mammalian cells, such as but not limited to, COS-1, COS-7, HEK293, BHK21, CHO, BSC-1, HepG2, 653, SP2/0, NS0, 293, HeLa, myeloma, lymphoma cells or any derivative thereof. Most preferably, the eukaryotic cell is a HEK293, NS0, SP2/0, or CHO cell. E. coli is an exemplary prokaryotic cell. A cell according to the invention may be generated by transfection, cell fusion, immortalization, or other procedures that are well known in the art. Polynucleotides transfected into a cell may be extrachromasomal or stably integrated into the chromosome of the cell.

The mimetibodies of the invention can be made more compatible with a given host cell by modification of the Hg—$C_H2$-$C_H3$ portion of the polypeptide. For example, when a mimetibody of the invention is expressed recombinantly in a bacterial cell such as E. coli, the Pro-Ala sequence in the Hg element may be removed to prevent digestion by the E. coli enzyme proline iminopeptidase. Similarly, a portion of the Hg element can be deleted or substituted with other amino acids in the mimetibodies of the invention to prevent heterogeneity in the products expressed in a selected host cell.

The present invention further provides a method to produce a mimetibody polypeptide comprising the steps of culturing a cell of the invention and purifying an expressed mimetibody polypeptide of the invention. Cell components, such as those necessary for in vitro transcription and translation, may also be used to express the polypeptides of the invention. The present invention encompasses mimetibodies produced by both methods. Expressed mimetibody polypeptides can be recovered and purified from cells or cell component based systems by methods well known in the art including, but not limited to, protein A purification, ammonium sulfate or ethanol precipitation, acid extraction, anion or cation exchange chromatography, phosphocellulose chromatography, hydrophobic interaction chromatography, affinity chromatography, hydroxylatpatite chromatography and lectin chromatography. High performance liquid chroatography (HPLC) can also be employed for purification. Typically purification will require a combination of several different methods.

Another aspect of the present invention is a pharmaceutical composition comprising an effective amount of at least one mimetibody polypeptide and a pharmaceutically acceptable carrier or diluent. The term "effective amount" generally refers to the quantity of mimetibody necessary for effective therapy, i.e., the partial or complete alleviation of the symptom or disorder for which treatment was sought. The composition can optionally comprise at least one further compound, protein or composition useful for treating obesity and the other conditions described below. The pharmaceutically acceptable carrier or diluent in the compositions can be a solution, suspension, emulsion, colloid or powder. Those skilled in the art will recognize other pharmaceutically acceptable carriers and diluents.

Another aspect of the present invention is a method of modifying the biological activity of a melanocortin receptor in a cell, tissue or organ comprising contacting the pharmaceutical compositions of the invention with the cell, tissue or organ. The method may be used to modify melanocortin receptor activity in the brain, brain tissue, or brain cells. Alternatively, the method of the invention may be used to modify melanocortin receptor activity in other peripheral cells or tissues such as muscle, or other organs such as the stomach. Those skilled in the art will recognize other cells, tissues or organs, which may be used.

Another aspect of the invention is a method of modulating at least one melanocortin receptor-mediated condition comprising administering a pharmaceutical composition of the invention to a patient in need thereof. The pharmaceutical compositions of the invention can be administered by any suitable route. Such routes may be intrathecal, intranasal, peripheral (e.g., subcutaneous, intramuscular, intradermal, intravenous) or by any other means known in the art. As described previously, abnormal melanocortin receptor activity has been implicated in a number of pathological conditions, such as obesity and Type 2 diabetes. Stimulation of MC4R can cause weight loss while inhibition may cause weight gain. The mimetibody polypeptides of the invention may be also be used to modulate other melanocortin receptor mediated conditions such as male and female erectile dysfunction, inflammation, congestive heart failure, central nervous system disorders, nerve damage, infectious disease, pulmonary disease, skin disease, fever and pain.

The present invention is further described with reference to the following examples. These examples are merely to illustrate aspects of the present invention and are not intended as limitations of this invention.

Example 1

Alpha-MSH Mimetibody and Expression Vector Construction

Figure 1:
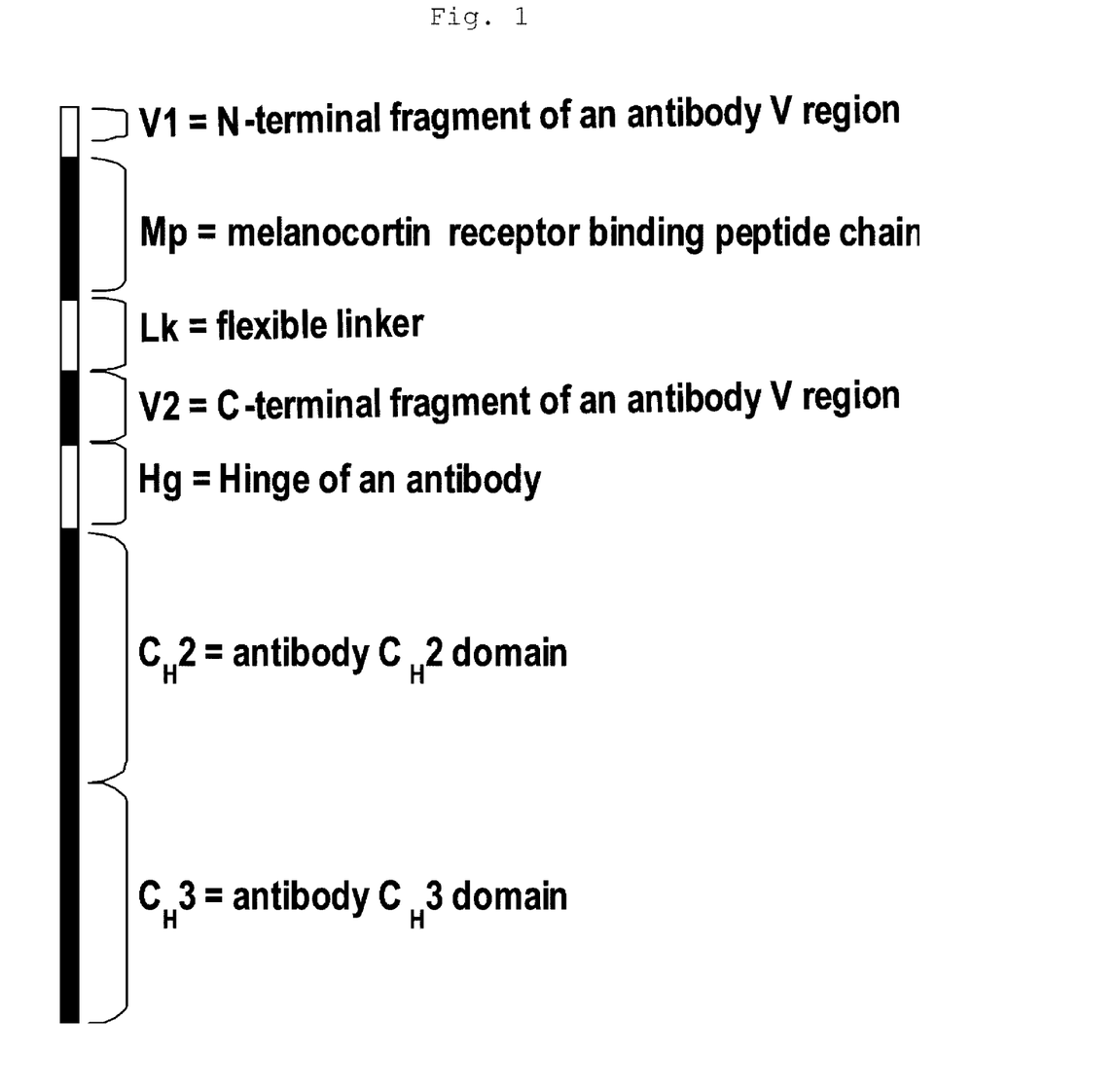
FIG. 1 shows elements of a melanocortin receptor binding mimetibody polypeptide.
Figure 2:
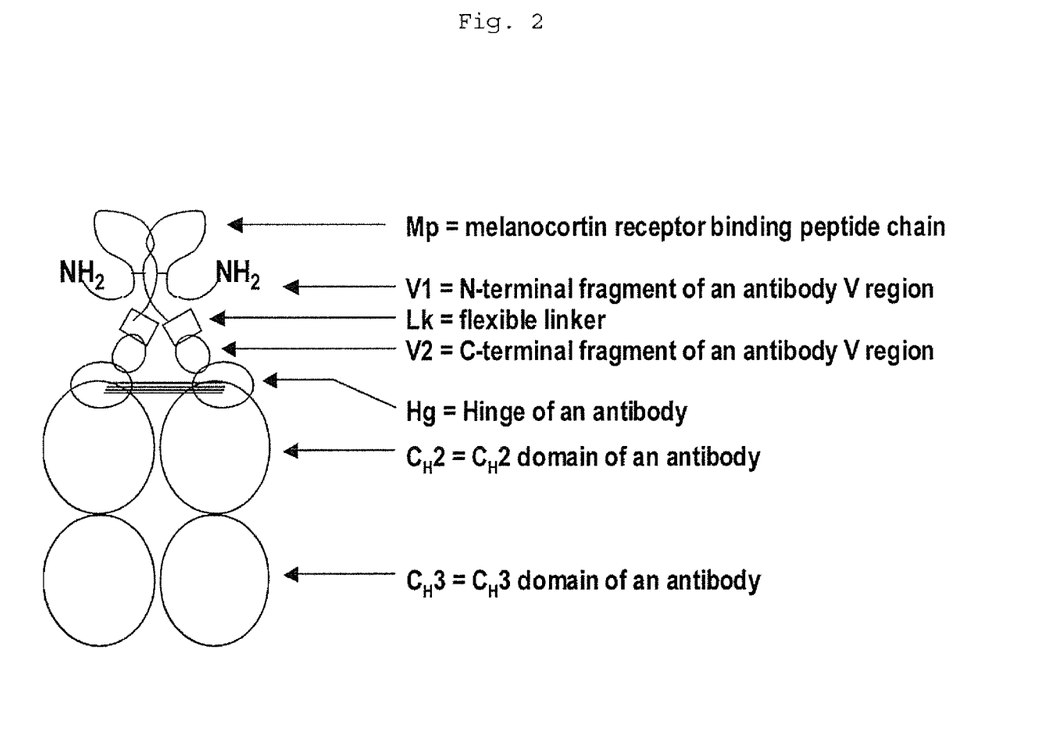
FIG. 2 is a cartoon of a melanocortin receptor binding mimetibody.
Figure 3:
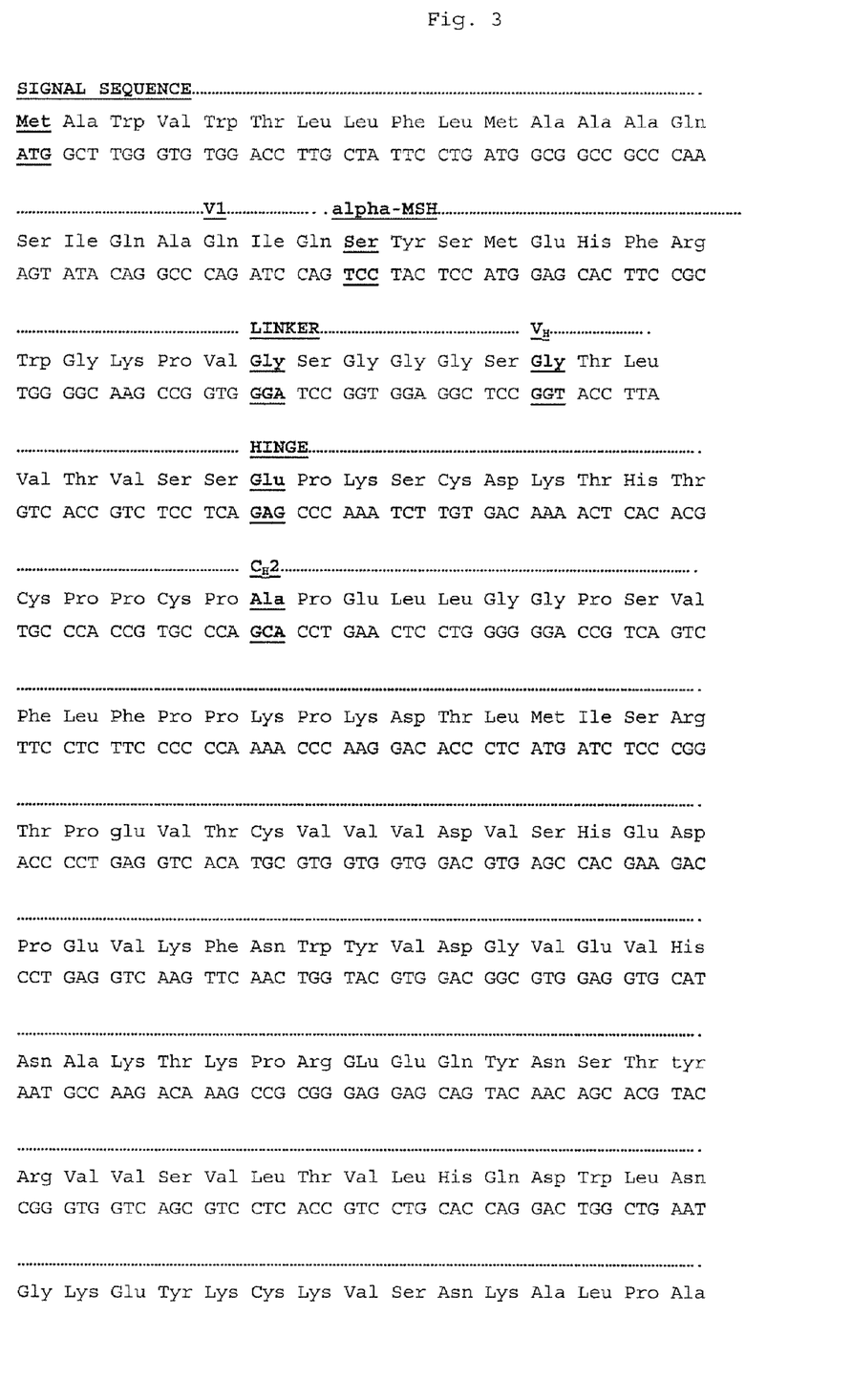
FIG. 3 shows the amino acid (SEQ ID NO: 62) and cDNA (SEQ ID NO: 61) sequences of a melanocortin receptor binding alpha-MSH mimetibody. The amino terminal portions of individual mimetibody elements are underlined.

An alpha-MSH mimetibody protein comprising a secretory signal sequence, an alpha-MSH peptide sequence, a linker sequence, $V_H$ sequence, a hinge sequence, a human IgG$_1$ C$_H$2 sequence and a human IgG$_1$ C$_H$3 sequence was designed (FIG. 3 and SEQ ID NO. 62) Analytical data, e.g., mass spectroscopy, has confirmed that a mature polypeptide is generated (61,344.6 for G1/G1 form). Nucleic acid sequences encoding this alpha-MSH mimetibody protein (FIG. 3; SEQ ID NO: 61) were generated using standard molecular biology techniques. Nucleic acid sequences encoding the alpha-MSH mimetibody sequence were subcloned into the p2389 expression vector to generate an alpha-MSH mimetibody expression vector (SEQ ID NO: 63).

Example 2

Alpha-MSH Mimetibody Expression

The alpha-MSH mimetibody was transiently expressed in HEK293E cells. Cells were cultured using standard conditions and transiently transfected with the alpha-MSH mimetibody expression vector using Lipofectamine 2000 (Invitrogen, Carlsbad, Calif.) as directed by the manufacturer. 24 h after transfection cells were transferred to a serum free media formulation and cultured for 5 days. The culture media was then removed and centrifuged to remove debris. Clarified media was incubated with Protein A-Sepharose™ (HiTrap rProtein A FF, Amersham Biosciences, Piscataway, N.J.) and proteins were eluted from the Protein A-Sepharose™ conjugate as directed by the manufacturer. The eluted protein solution was then further purified via Superose™ 12 size exclusion chromatography (Superose 12 10/300 GL, Amersham Biosciences, Piscataway, N.J.) using standard methods. Column eluant was then subjected to SDS-PAGE and visualized by silver and Coomassie blue staining. Western blots were then prepared and the blots were probed with either an Fc specific primary antibody or an alpha-MSH specific primary antibody. Together, the Western Blot and SDS-PAGE staining results indicated that a purified alpha-MSH mimetibody, composed of two polypeptide chains, had been obtained from the transiently transfected HEK293 cells.

Example 3

Alpha-MSH Mimetibody Binds MC4R

Figure 4:
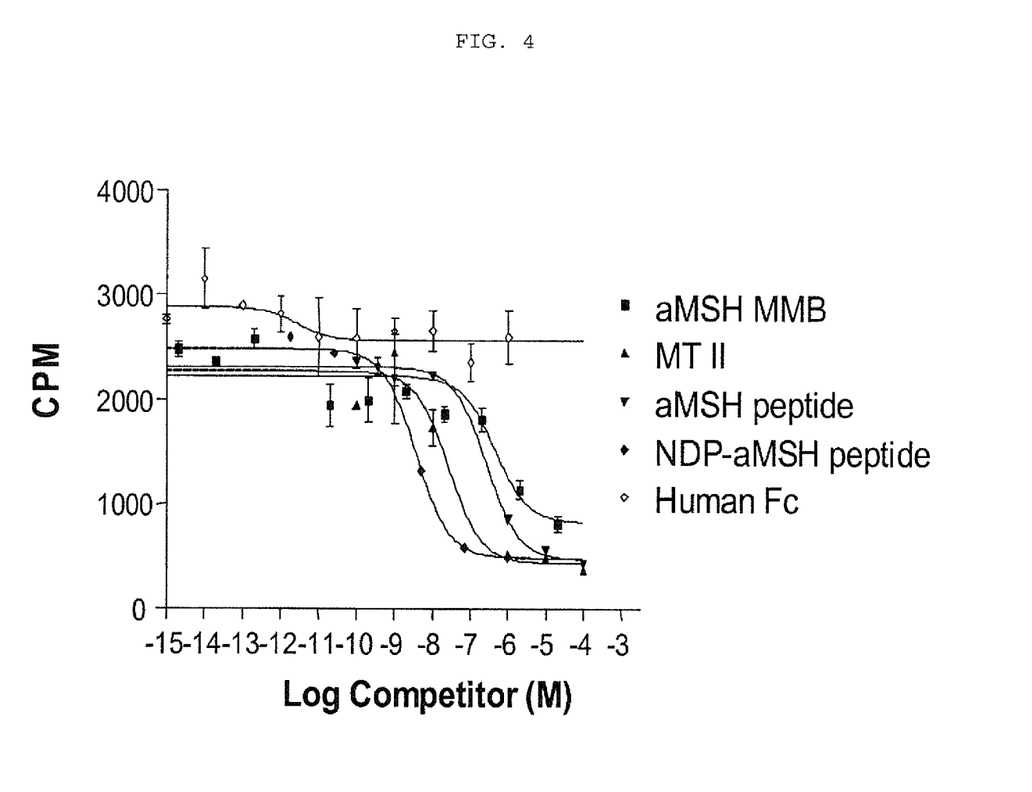
FIG. 4 shows alpha-MSH mimetibody binding to MC4R in a competitive binding assay.

The alpha-MSH mimetibody binds to MC4R and can compete with radiolabeled [Nle(4), D-Phe(7)]-alpha-MSH (NDP-alpha-MSH) agonist molecules for MC4R binding (FIG. 4). MC4R is a receptor for alpha-MSH. alpha-MSH binding to recombinantly expressed MC4R in HEK293 cell membranes (Perkin Elmer Life and Analytical Sciences, Boston, Mass.) was examined by competitive binding assays in which increasing amounts of unlabeled MC4R agonists (positive controls) and the Fc domain of a human antibody (negative control) were added to assay cocktails containing [$^{125}$I]-NDP-alpha-MSH as indicated in FIG. 4. The unlabeled MC4R agonists were melanotan II (MTII; an alpha MSH analog), alpha-MSH, and NDP-alpha-MSH. Alpha-MSH mimetibody binding to MC4R was stable after two weeks of storage at 4° C., −20° C., and −80° C. in PBS (phosphate buffered saline) as assessed by competitive binding assays.

Competitive binding assays were performed using Scintillation Proximity Assays® (Amersham Biosciences Corp, Piscataway, N.J.) as directed by the assay manufacturer. Assay cocktails contained [$^{125}$I]-NDP-alpha-MSH at EC80, i.e., ~0.5 nM, 0.1 µg of MC4R membranes, 1 mM MgS0$_4$, 1.5 mM CaCl$_2$, 25 mM Hepes, 0.2% BSA, 1 mM 1,10-phenthroline, an assay manufacturer recommended quantity of protease inhibitor cocktail (Roche Diagnostics Corp., Indianapolis, Ind.) and SPA beads. Light emission from Scintillation Proximity Assay® beads was measured with a Packard Top Count NXT Instrument (Perkin Elmer Life and Analytical Sciences, Boston, Mass.) for 5 minutes.

Example 4

Alpha-MSH Mimetibody Activates MC4R

Figure 5:
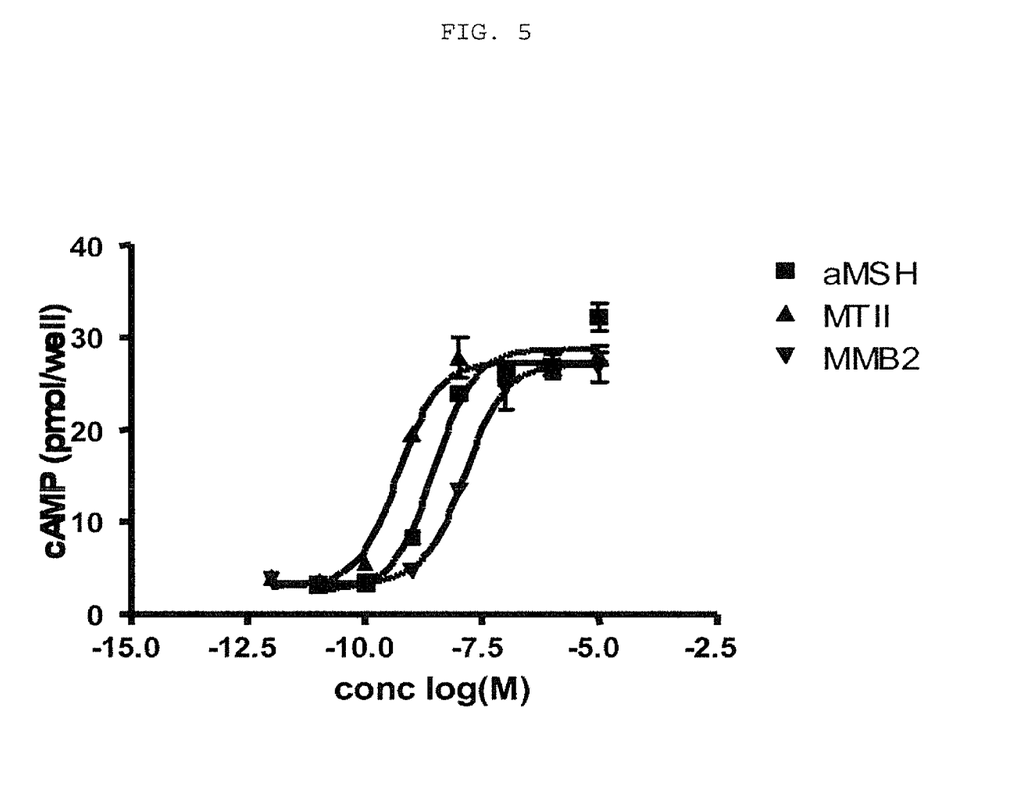
FIG. 5 shows alpha-MSH mimetibody activation of MC4R in cells expressing a high level of MC4R.
Figure 6:
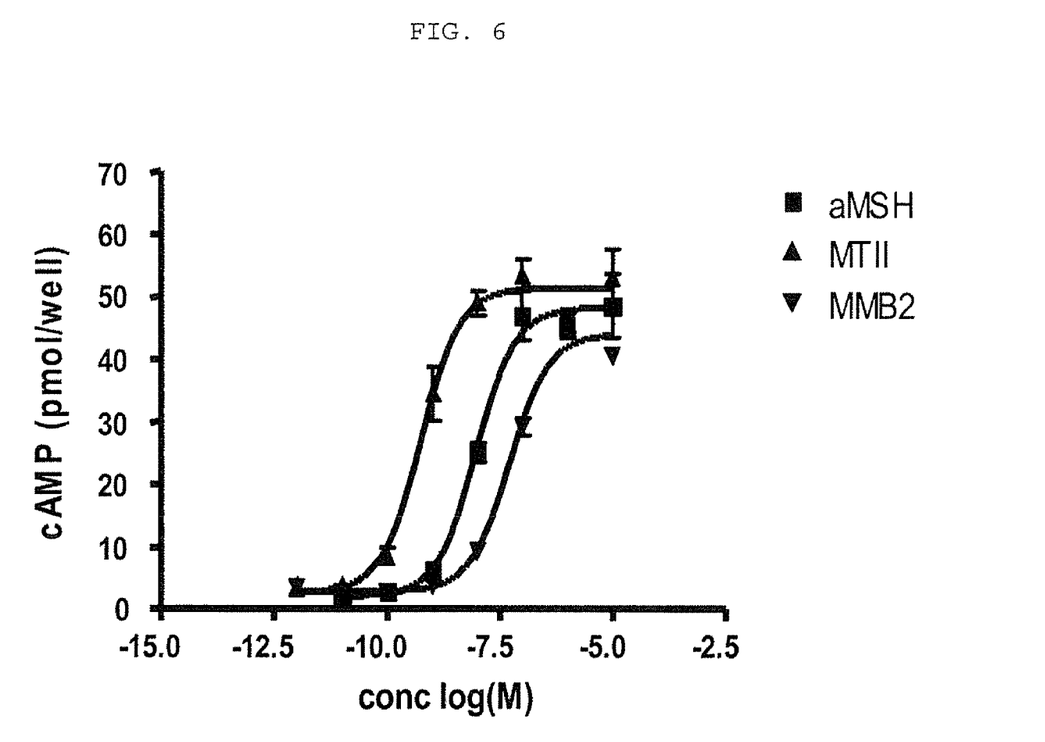
FIG. 6 shows alpha-MSH mimetibody activation of MC4R in cells expressing a low level of MC4R.

The alpha-MSH mimetibody can activate MC4R signaling to increase cAMP production in CHOK1 cells expressing MC4R (FIG. 5 and FIG. 6). MC4R is a seven transmembrane (7TM) G-protein coupled receptor. Activation of MC4R by ligand or agonist results in an increase in cyclic AMP levels (cAMP).

MC4R receptor activation assays were performed using two different clonal CHOK1 cell lines stably transfected with a MC4R expression vector and expressing MC4R. Clone 1 (FIG. 5) expressed MC4R at high levels relative to Clone 2 (FIG. 6). Clone 1 and Clone 2 cells were grown as a monolayer using standard culture conditions to a density of approximately 100,000 cells/well and then incubated with increasing amounts (0-100 µM) of alpha-MSH, MTII, or alpha-MSH mimetibody for 15 minutes as indicated in FIG. 5 and FIG. 6. Cells were then lysed and cAMP assays were performed using the cAMP-Screen Direct™ Chemiluminescent Immunoassay System (Applied Biosystems, Foster City, Calif.) as directed by the manufacturer. EC$_{50}$ values from cAMP assays using Clone 1 (FIG. 5) and Clone 2 (FIG. 6) are listed in Table 1 below

TABLE 1

|  | Clone 1 | Clone 2 |
|---|---|---|
| alpha-MSH peptide (Positive control) | EC$_{50}$ = 3.29 nM | EC$_{50}$ = 9.46 nM |
| MT II (Positive control) | EC$_{50}$ = 0.52 nM | EC$_{50}$ = 0.52 nM |
| alpha-MSH mimetibody | EC$_{50}$ = 14.36 nM | EC$_{50}$ = 52.4 nM |

Example 5

Figure 7:
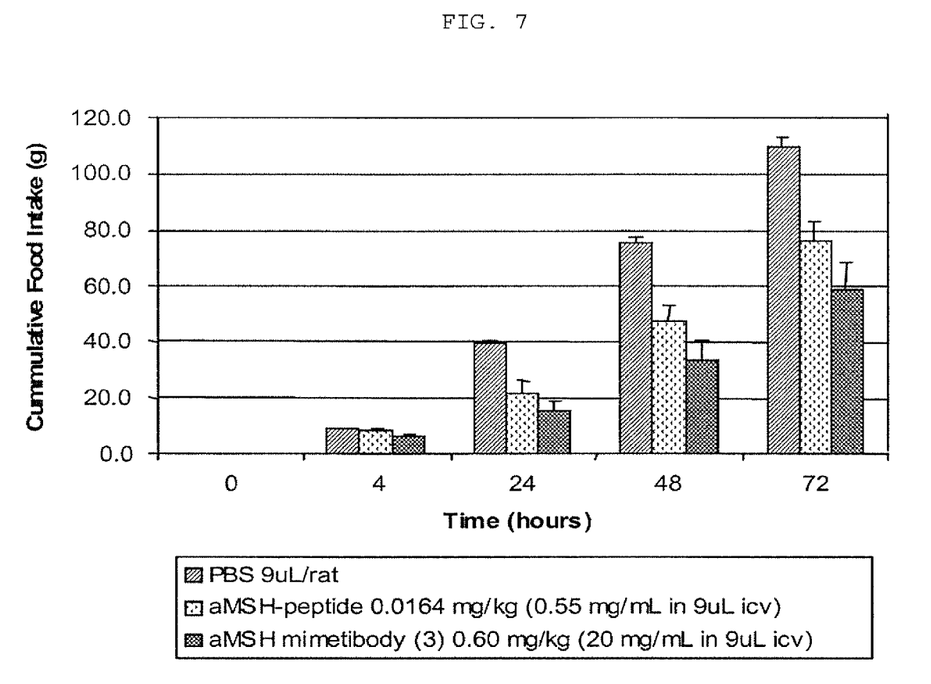
FIG. 7 shows alpha-MSH mimetibody-mediated decrease in animal food intake.
Figure 8:
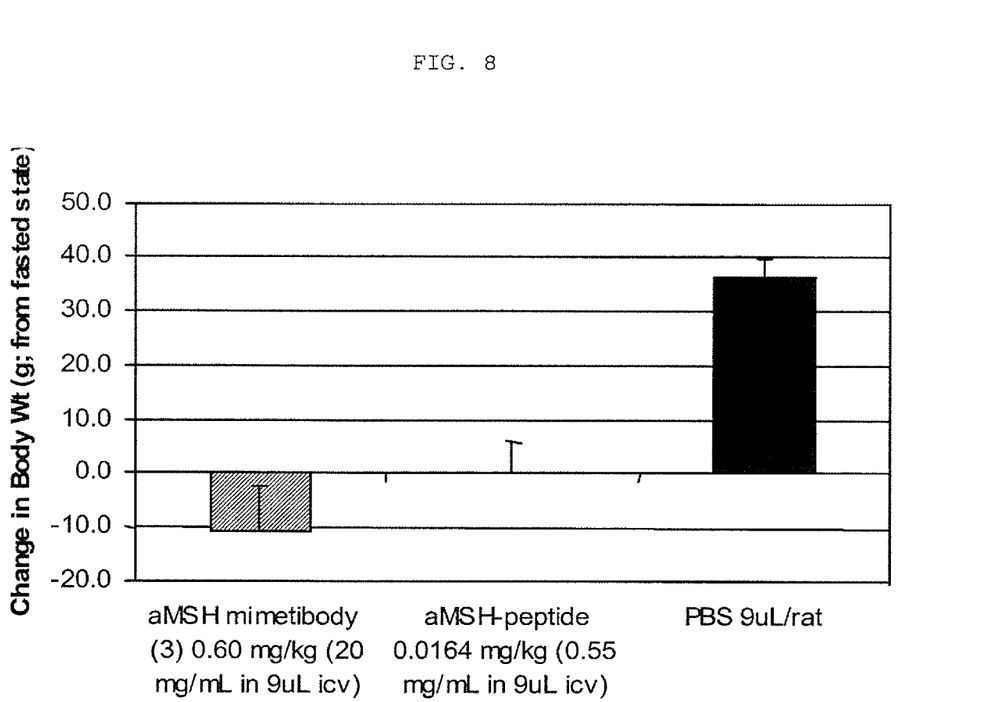
FIG. 8 shows alpha-MSH mimetibody-mediated decrease in animal body weight.

Alpha-MSH Mimetibody Administration Decreases Animal Food Intake and Body Weight Alpha-MSH mimetibody administration to *Rattus norvegicus* brain ventricules decreases animal food intake (FIG. 7)

and body weight (FIG. 8). Alpha-MSH mimetibody was supplied to brain ventricules by intracerebroventricular injections (ICV) via a cannula surgically inserted into the left lateral brain ventricle.

Cannulae were surgically inserted into male Sprague-Dawley or Wistar rats weighing 250 g to 350 g. Cannula placement coordinates were as follows: −0.8 mm from bregma, −4.5 mm ventral and −1.5 posterior-anterior. Animals recovered for 7 to 10 days after surgery. Animals were acclimatized to the experimental procedures by both daily handling and mock injection, in order to minimize stress. In addition animals were submitted to the reversal of dark-light cycle.

Proper cannula placement was confirmed by an angiotensin II test. The test confirmed proper cannula placement if the ICV administration of 10 ng of angiotensin II via the cannula caused the rats to drink 5-10 ml of water in 30 minutes. Only animals that passed this angiotensin II test were used in food intake experiments.

Animals were fasted for 18-24 hours and alpha-MSH mimetibody, alpha-MSH (positive control), or PBS (negative control) were then administered to the brain ventricles via the cannula at an injection rate of 9 µl/min. Each treatment group had a minimum of 7 animals. Treatments and dosages were as indicated in FIG. 7 and FIG. 8.

Food and water was given to the animals after injection. The amount of food and water consumed was measured at 0 h, 4 h, 24 h, 48 h and 72 h (FIG. 7) after injection. Body weight at 72 hours post injection was measured as shown in FIG. 8.

The present invention now being fully described, it will be apparent to one of ordinary skill in the art that many changes and modifications can be made thereto without departing from the spirit or scope of the appended claims.

SEQUENCE LISTING (282 sequences)

SEQ ID NO: 1 - DNA, 39 bp, Homo sapiens
tcctactccatggagcacttccgctggggcaagccggtg

SEQ ID NO: 2 - protein, 13 aa, Homo sapiens
SYSMEHFRWGKPV

SEQ ID NO: 3 - DNA, 39 bp, Artificial Sequence
  In Vitro synthesized DNA encoding a constrained peptide sequence
agctatagctgcgaacattttcgctggtgcaaaccggtg

SEQ ID NO: 4 - protein, 13 aa, Artificial Sequence
  Constrained peptide encoded by an in vitro synthesized DNA
SYSCEHFRWCKPV

SEQ ID NO: 5 - DNA, 39 bp, Artificial Sequence
  In Vitro synthesized DNA encoding a constrained peptide sequence
agctattgcatggaacattttcgctggtgcaaaccggtg

SEQ ID NO: 6 - protein, 13 aa, Artificial Sequence
  Constrained peptide encoded by an In Vitro synthesized DNA
SYCMEHFRWCKPV

SEQ ID NO: 7 - DNA, 39 bp, Artificial Sequence
  In Vitro synthesized DNA encoding a constrained peptide sequence
agctgcagcatggaacattttcgctggtgcaaaccggtg

SEQ ID NO: 8 - protein, 13 aa, Artificial Sequence
  Constrained peptide encoded by an In Vitro synthesized DNA
SCSMEHFRWCKPV

SEQ ID NO: 9 - DNA, 39 bp, Artificial Sequence
  In Vitro synthesized DNA encoding a constrained peptide sequence
tgctatagcatggaacattttcgctggggctgcccggtg

SEQ ID NO: 10 - protein, 13 aa, Artificial Sequence
  Constrained peptide encoded by an In Vitro synthesized DNA
CYSMEHFRWGCPV

SEQ ID NO: 11 - DNA, 45 bp, Artificial Sequence
  In Vitro synthesized DNA encoding a constrained peptide sequence
agctggagctgggaacattttcgctggggcaaatggacctggaaa

SEQ ID NO: 12 - protein, 15 aa, Artificial Sequence
  Constrained peptide encoded by an In Vitro synthesized DNA
SWSWEHFRWGKWTWK

SEQ ID NO: 13 - DNA, 51 bp, Artificial Sequence
  In Vitro synthesized DNA encoding a constrained peptide sequence
agctggagctggggcgaacattttcgctggggcaaaggctggacctggaaa

SEQ ID NO: 14 - protein, 16 aa, Artificial Sequence
  Constrained peptide encoded by an In Vitro synthesized DNA
SWSWGEHFRWGKGWTW

SEQ ID NO: 15 - DNA, 57 bp, Artificial Sequence
  In Vitro synthesized DNA encoding a constrained peptide sequence
agctggagctggggcggcgaacattttcgctggggcaaaggcggctggacctggaaa

SEQ ID NO: 16 - protein, 16 aa, Artificial Sequence
  Constrained peptide encoded by an In Vitro synthesized DNA
SWSWGGEHFRWGKGGW

SEQ ID NO: 17 - DNA, 57 bp, Artificial Sequence
  In Vitro synthesized DNA encoding a constrained peptide sequence
agctggagctggagcatggaacattttcgctggggcaaaccggtgtggacctggaaa

SEQ ID NO: 18 - protein, 16 aa, Artificial Sequence
  Constrained peptide encoded by an In Vitro synthesized DNA
SWSWSMEHFRWGKPVW

SEQ ID NO: 19 - DNA, 12 bp, Artificial Sequence
  In Vitro synthesized DNA encoding a flexible peptide sequence
ggcagcggcagc

SEQ ID NO: 20 - protein, 4 aa, Artificial Sequence
  Flexible peptide encoded by an In Vitro synthesized DNA
GSGS

SEQ ID NO: 21 - DNA, 12 bp, Artificial Sequence
  In Vitro synthesized DNA encoding a flexible peptide sequence
ggcggcagcggc

SEQ ID NO: 22 - protein, 4 aa, Artificial Sequence
  Flexible peptide encoded by an In Vitro synthesized DNA
GGSG

SEQ ID NO: 23 - DNA, 18 bp, Artificial Sequence
  In Vitro synthesized DNA encoding a flexible peptide sequence
ggcagcggcggcggcagc

SEQ ID NO: 24 - protein, 6 aa, Artificial Sequence
  Flexible peptide encoded by an In Vitro synthesized DNA
GSGGGS

SEQ ID NO: 25 - DNA, 21 bp, Artificial Sequence
  In Vitro synthesized DNA encoding a flexible peptide sequence
ggcagcggcggcggcagcggc

SEQ ID NO: 26 - protein, 7 aa, Artificial Sequence
  Flexible peptide encoded by an In Vitro synthesized DNA
GSGGGSG

SEQ ID NO: 27 - DNA, 12 bp, Artificial Sequence
  In Vitro synthesized DNA encoding a flexible peptide sequence
ggcagcagcggc

SEQ ID NO: 28 - protein, 4 aa, Artificial Sequence
  Flexible peptide encoded by an In Vitro synthesized DNA
GSSG

SEQ ID NO: 29 - DNA, 18 bp, Artificial Sequence
  In Vitro synthesized DNA encoding a flexible peptide sequence
ggcagcggcggcggcagc

SEQ ID NO: 30 - protein, 6 aa, Artificial Sequence
  Flexible peptide encoded by an In Vitro synthesized DNA
GSGGGS

SEQ ID NO: 31 - DNA, 24 bp, Homo sapiens
ggcaccctggtgaccgtgagcagc

SEQ ID NO: 32 - protein, 8 aa, Homo sapiens
GTLVTVSS

SEQ ID NO: 33 - DNA, 21 bp, Artificial Sequence
  In Vitro mutagenized homo sapien DNA encoding a V2 peptide sequence comprising a T to A substitution to limit O-linked glycosylation
accctggtggcggtgagcagc

SEQ ID NO: 34 - protein, 7 aa, Artificial Sequence
  Mutagenized homo sapien V2 peptide sequence comprising a T to A substitution to limit O-linked glycosylation and encoded by an In Vitro mutagenized homo sapien DNA
TLVAVSS

SEQ ID NO: 35 - DNA, 45 bp, Homo sapiens
gaaccgaaaagctgcgataaaacccatacctgcccgccgtgcccg

SEQ ID NO: 36 - protein, 15 aa, Homo sapiens
EPKSCDKTHTCPPCP

SEQ ID NO: 37 - DNA, 45 bp, Homo sapiens
gaaccgaaaagcgcggataaaacccatacctgcccgccgtgcccg

SEQ ID NO: 38 - protein, 15 aa, Homo sapiens
EPKSADKTHTCPPCP

SEQ ID NO: 39 - DNA, 36 bp, Homo sapiens
gaaagcaaatatggcccgccgtgcccgagctgcccg

SEQ ID NO: 40 - protein, 12 aa, Homo sapiens
ESKYGPPCPSCP

SEQ ID NO: 41 - DNA, 36 bp, Homo sapiens
gaaagcaaatatggcccgccgtgcccgccgtgcccg

SEQ ID NO: 42 - protein, 12 aa, Homo sapiens
ESKYGPPCPPCP

SEQ ID NO: 43 - DNA, 15 bp, Homo sapiens
tgcccgccgtgcccg

SEQ ID NO: 44 - protein, 5 aa, Homo sapiens
CPPCP

SEQ ID NO: 45 - DNA, 12 bp, Homo sapiens
tgcccgagctgc

SEQ ID NO: 46 - protein, 4 aa, Homo sapiens
CPSC

SEQ ID NO: 47 - DNA, 330 bp, Homo sapiens
gcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaa

SEQ ID NO: 48 - protein, 110 aa, Homo sapiens
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 49 - DNA, 330 bp, Homo sapiens
gcgccggaagcggcgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaa

SEQ ID NO: 50 - protein, 110 aa, Homo sapiens
APEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 51 - DNA, 330 bp, Homo sapiens
gcgccggaatttctgggcggcccgagcgtgtttctgtttccgccgaaaccgaaagataccctgatgattagccgcaccccggaagtgacctgcgtggtggtggatgtgagccaggaagatccggaagtgcagtttaactggtatgtggatggcgtggaagtgcataacgcgaaaaccaaaccgcgcgaagaacagtttaacagcacctatcgcgtggtgagcgtgctgaccgtgctgcatcaggattggctgaacggcaaagaatataaatgcaaagtgagcaacaaaggcctgccgagcagcattgaaaaaaccattagcaaagcgaaa

SEQ ID NO: 52 - protein, 110 aa, Homo sapiens
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 53 - DNA, 330 bp, Homo sapiens
gcgccggaagcggcgggcggcccgagcgtgtttctgtttccgccgaaaccgaaagataccctgatgattagccgcaccccggaagtgacctgcgtggtggtggatgtgagccaggaagatccggaagtgcagtttaactggtatgtggatggcgtggaagtgcataacgcgaaaaccaaaccgcgcgaagaacagtttaacagcacctatcgcgtggtgagcgtgctgaccgtgctgcatcaggattggctgaacggcaaagaatataaatgcaaagtgagcaacaaaggcctgccgagcagcattgaaaaaaccattagcaaagcgaaa

SEQ ID NO: 54 - protein, 110 aa, Homo sapiens
APEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 55 - DNA, 321 bp, Homo sapiens
ggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 56 - protein, 107 aa, Homo sapiens
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - DNA, 321 bp, Homo sapiens
ggccagccgcgcgaaccgcaggtgtataccctgccgccgagccaggaagaaatgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagccgcctgaccgtggataaaagccgctggcaggaaggcaacgtgtttagctgcagcgtgatgcatgaagcgctgcataaccattatacccagaaaagcctgagcctgagcctgggcaaa

SEQ ID NO: 58 - protein, 107 aa, Homo sapiens
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 59 - DNA, 777 bp, Artificial Sequence
  In vitro synthesized DNA encoding a melanocortin receptor binding alpha-MSH mimetibody without secretory signal (p3024)
tcctactccatggagcacttccgctggggcaagccggtgggatccggtggaggctccggtaccttagtcaccgtctcctcagagcccaaatcttgtgacaaaactcacacgtgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 60 - protein, 259 aa, Artificial Sequence
  Melanocortin receptor binding alpha-MSH Mimetibody without secretory signal encoded by an in vitro synthesized DNA (p3024).
SYSMEHFRWGKPVGSGGGSGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 843 bp, Artificial Sequence
  In Vitro synthesized DNA encoding a Melanocortin receptor binding alpha-MSH mimetibody with secretory signal and V1
atggcttgggtgtggaccttgctattcctgatggcggccgcccaaagtatacaggcccagatccagtcctactccatggagcacttccgctggggcaagccggtgggatccggtggaggctccggtaccttagtcaccgtctcctcagagcccaaatcttgtgacaaaactcacacgtgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 62 - protein, 281 aa, Artificial Sequence
  Melanocortin receptor binding alpha-MSH mimetibody with secretory signal and V1 encoded by an in vitro synthesized DNA
MAWVWTLLFLMAAAQSIQAQIQSYSMEHFRWGKPVGSGGGSGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - DNA, 11978 bp, Artificial Sequence
  In vitro synthesized DNA with expression vector functions that encodes an alha-MSH mimetibody
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcccagatccagtcctactccatggagcacttccgctggggcaagccggtgggatccggtggaggctccggtaccttagtcaccgtctcctcagagcccaaatcttgtgacaaaactcacacgtgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 64 - DNA, 696 bp, Homo sapiens
gaaccgaaaagctgcgataaaacccatacctgcccgccgtgcccggcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgatgaactgaccaaaaaccaggtgagcctgacctgcctggtgaaaggcttttatccgagcgatattgcggtggaatgggaaagcaacggccagccggaaaacaactataaaaccaccccgccggtgctggatagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcaaa

SEQ ID NO: 65 - protein, 232 aa, Homo sapiens
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - DNA, 45 bp, Homo sapiens
atgattagccgcaccccgaccgtgctgcatcagcataaccattat

SEQ ID NO: 67 - protein, 15 aa, Homo sapiens
  In vitro synthesized DNA with expression vector functions that encodes an alpha-MSH mimetibody
MISRTPTVLHQHNHY

SEQ ID NO: 68 - DNA, 57 bp, Homo sapiens
atggcttgggtgtggaccttgctattcctgatggcggccgcccaaagtatacaggcc

SEQ ID NO: 69 - protein, 19 aa, Homo sapiens
MAWVWTLLFLMAAAQSIQA

SEQ ID NO: 70 - DNA, 951 bp, Homo sapiens
atggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcaccgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacgtgctcctgg

SEQ ID NO: 71 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSTVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 72 - DNA, 891 bp, Homo sapiens
atgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactgg

SEQ ID NO: 73 - protein, 297 aa, Homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 74 - DNA, 1080 bp, Homo sapiens
atgagcatccaaaagacgtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgaggttttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttggga

SEQ ID NO: 75 - protein, 360 aa, Homo sapiens
MSIQKTYLEGDFVFPVSSSSFLRTLLEPQLGSALLTAMNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 76 - DNA, 999 bp, Homo sapiens
atggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattatcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaa

SEQ ID NO: 77 - protein, 332 aa, Homo sapiens
MVNSTHRGMHTSLHLWNRSSYRLHSNASESLGKGYSDGGCYEQLFVSPEVFVTLGVISLLENILVIVAIAKNKNLHSPMYFFICSLAVADMLVSVSNGSETIIITLLNSTDTDAQSFTVNIDNVIDSVICSSLLASICSLLSIAVDRYFTIFYALQYHNIMTVKRVGIIISCIWAACTVSGILFIIYSDSSAVIICLITMFFTMLALMASLYVHMFLMARLHIKRIAVLPGTGAIRQGANMKGAITLTILIGVFVVCWAPFFLHLIFYISCPQNPYCVCFMSHFNLYLILIMCNSIIDPLIYALRSQELRKTFKEIICCYPLGGLCDLSSRY

SEQ ID NO: 78 - DNA, 975 bp, Homo sapiens
atgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggat

SEQ ID NO: 79 - protein, 325 aa, Homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 80 - DNA, 12 bp, Homo sapiens
cattttcgctgg

SEQ ID NO: 81 - protein, 4 aa, Homo sapiens
HFRW

SEQ ID NO: 82 - DNA, 12 bp, Artificial Sequence
  In Vitro synthesized DNA encoding a peptide that is a modification of alpha-MSH HFRW core amino acid sequence
tttcattggatg

SEQ ID NO: 83 - protein, 4 aa, Artificial Sequence
  A peptide that is a modification of alpha-MSH HFRW core amino acid sequence and is encoded by an in vitro synthesized DNA
FHWM

SEQ ID NO: 84 - DNA, 12 bp, Artificial Sequence
  In vitro synthesized DNA encoding a flexible peptide sequence
ggcggcggcagc

SEQ ID NO: 85 - protein, 4 aa, Artificial Sequence
  Flexible peptide encoded by an in vitro synthesized DNA
GGGS

SEQ ID NO: 86 - DNA, 39 bp, Artificial Sequence
  In vitro synthesized DNA encoding a constrained peptide sequence
tcctactgcggcgagcacttccgctggggctgcccggtg

SEQ ID NO: 87 - protein, 13 aa, Artificial Sequence
  Constrained peptide encoded by an in vitro synthesized DNA.
SYCGEHFRWGCPV

SEQ ID NO: 88 - DNA, 39 bp, Artificial Sequence
  In vitro synthesized DNA encoding a constrained peptide sequence.
tcctactcctgcgagcacttccgctggggcaagccgtgc

SEQ ID NO: 89 - protein, 13 aa, Artificial Sequence
  Constrained peptide encoded by an in vitro synthesized DNA.
SYSCEHFRWGKPC

SEQ ID NO: 90 - DNA, 39 bp, Artificial Sequence
  In vitro synthesized DNA encoding a constrained peptide sequence.
tcctactgcatggagcacttccgctggggctgcccggtg

SEQ ID NO: 91 - protein, 13 aa, Artificial Sequence
  Constrained peptide encoded by an in vitro synthesized DNA.
SYCMEHFRWGCPV

SEQ ID NO: 92 - DNA, 39 bp, Artificial Sequence
  In vitro synthesized DNA encoding a constrained peptide sequence.
tcctgctccatggagcacttccgctggggctgcccggtg

SEQ ID NO: 93 - protein, 13 aa, Artificial Sequence
  Constrained peptide encoded by an in vitro synthesized DNA.
SCSMEHFRWGCPV

SEQ ID NO: 94 - DNA, 39 bp, Artificial Sequence
  In vitro synthesized DNA encoding a constrained peptide sequence.
tcctactcctgcgagcacttccgctggggctgcccggtg

SEQ ID NO: 95 - protein, 13 aa, Artificial Sequence
  Constrained peptide encoded by an in vitro synthesized DNA.
SYSCEHFRWGCPV

SEQ ID NO: 96 - DNA, 39 bp, Artificial Sequence
  In vitro synthesized DNA encoding a constrained peptide sequence.
tcctactcctgcgagcacttccgctggggcaagtgcgtg

SEQ ID NO: 97 - protein, 13 aa, Artificial Sequence
  Constrained peptide encoded by an in vitro synthesized DNA.
SYSCEHFRWGKCV

SEQ ID NO: 98 - DNA, 15 bp, Artificial Sequence
  In vitro synthesized DNA encoding a flexible peptide sequence.
ggaggaggcggatcc

SEQ ID NO: 99 - protein, 5 aa, Artificial Sequence
  Flexible peptide encoded by an in vitro synthesized DNA.
GGGGS

SEQ ID NO: 100 - DNA, 30 bp, Artificial Sequence
  In vitro synthesized DNA encoding a flexible peptide sequence.
ggaggcggaggaagcggcggaggcggatcc

SEQ ID NO: 101 - protein, 10 aa, Artificial Sequence
  Flexible peptide encoded by an in vitro synthesized DNA.
GGGGSGGGGS

SEQ ID NO: 102 - DNA, 45 bp, Artificial Sequence
  In vitro synthesized DNA encoding a flexible peptide sequence.
gggggcggaggaagcggcggaggcgggagcggcggcggaggatcc

SEQ ID NO: 103 - protein, 15 aa, Artificial Sequence
  Flexible peptide encoded by an in vitro synthesized DNA.
GGGGSGGGGSGGGGS

SEQ ID NO: 104 - DNA, 60 bp, Artificial Sequence
  In vitro synthesized DNA encoding a flexible peptide sequence.
gggggcggaggaagcggcggaggcgggagcggcggcggaggctccggtggcggaggatcc

SEQ ID NO: 105 - protein, 20 aa, Artificial Sequence
  Flexible peptide encoded by an in vitro synthesized DNA.
GGGGSGGGGSGGGGSGGGGS

SEQ ID NO: 106 - DNA, 45 bp, Artificial Sequence
  In vitro mutagenized Homo sapien DNA encoding a Hg peptide sequence comprising a T to A substitution to limit O-linked glycosylation.
gagcccaaatcttgtgacaaaactcacgcctgcccaccgtgccca

SEQ ID NO: 107 - protein, 15 aa, Artificial Sequence
  Mutagenized Homo sapien Hg peptide sequence comprising a T to A substitution to limit O-linked glycosylation this is encoded by an in vitro mutagenized Homo sapien DNA.
EPKSCDKTHACPPCP

SEQ ID NO: 108 - DNA, 45 bp, Artificial Sequence
  In vitro mutagenized Homo sapien DNA encoding a Hg peptide sequence comprising a C to A substitution to limit aggregation or multimerization.
gagcccaaatctgccgacaaaactcacacgtgcccaccgtgccca

SEQ ID NO: 109 - protein, 15 aa, Artificial Sequence
  Mutagenized Homo sapien Hg peptide sequence comprising a C to A substitution to limit aggregation or multimerization that is encoded by an in vitro mutagenized Homo sapien DNA.
EPKSADKTHTCPPCP

SEQ ID NO: 110 - DNA, 45 bp, Artificial Sequence
  In vitro mutagenized Homo sapien DNA encoding a Hg peptide sequence comprising a C to A substitution to limit aggregation or multimerization and a T to A substitution to limit O-linked glycosylation.
gagcccaaatctgccgacaaaactcacgcctgcccaccgtgccca

SEQ ID NO: 111 - protein, 15 aa, Artificial Sequence
  Mutagenized Homo sapien Hg peptide sequence comprising a C to A substitution to limit aggregation or multimerization and a T to A substitution to limit O-linked glycosylation.  The peptide is encoded by
  an in vitro mutagenized Homo sapien DNA.
EPKSADKTHACPPCP

SEQ ID NO: 112 - DNA, 15 bp, Artificial Sequence
  In vitro synthesized DNA encoding an amino terminal portion of an immunoglobulin variable region that has been modified for increased flexibility by the addition of G residues.
cagatccagggaggc

SEQ ID NO: 113 - protein, 5 aa, Artificial Sequence
  Amino terminal portion of an immunoglobulin variable region peptide that has been modified for increased flexibility by the addition of G residues.  The peptide is encoded by an in vitro
  synthesized DNA.
QIQGG

SEQ ID NO: 114 - DNA, 21 bp, Artificial Sequence
  In vitro synthesized DNA encoding an amino terminal portion of an immunoglobulin variable region that has been modified for increased flexibility by the addition of G residues.
cagatccagggaggcggaggc

SEQ ID NO: 115 - protein, 7 aa, Artificial Sequence
  Amino terminal portion of an immunoglobulin variable region peptide that has been modified for increased flexibility by the addition of G residues.  The peptide is encoded by an in vitro
  synthesized DNA.
QIQGGGG

SEQ ID NO: 116 - DNA, 330 bp, Homo sapiens
gcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaa

SEQ ID NO: 117 - protein, 110 aa, Homo sapiens; identical to SEQ ID NO: 54

SEQ ID NO: 118 - DNA, 321 bp, Homo sapiens
gggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 119 - protein, 107 aa, Homo sapiens; identical to SEQ ID NO: 58

SEQ ID NO: 120 - DNA, 777 bp, Artificial Sequence
  In vitro synthesized DNA encoding a melanocortin receptor binding alpha-MSH mimetibody without secretory signal (p3309).
tcctactccatggagcacttccgctggggcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 121 - protein, 259 aa, Artificial Sequence
  Melanocortin receptor binding alpha-MSH mimetibody without secretory signal encoded by an in vitro synthesized DNA (p3309).
SYSMEHFRWGKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - DNA, 834 bp, Artificial Sequence
  In vitro synthesized DNA encoding a melanocortin receptor binding alpha-MSH mimetibody with secretory signal (p3309).
atggcttgggtgtggaccttgctattcctgatggcggccgcccaaagtatacaggcctcctactccatggagcacttccgctggggcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 123 - protein, 278 aa, Artificial Sequence
  Melanocortin receptor binding alpha-MSH mimetibody with secretory signal encoded by an in vitro synthesized DNA (p3309).
MAWVWTLLFLMAAAQSIQASYSMEHFRWGKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - DNA, 24 bp, Homo sapiens
aaaaaaaaaaaaaaaaaaaaaaaa

SEQ ID NO: 125 - DNA, 11969 bp, Artificial Sequence
  In vitro synthesized DNA with expression vector functions that encodes an alpha-MSH mimetibody (p3309).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactccatggagcacttccgctggggcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 126 - DNA, 720 bp, Artificial Sequence
  In vitro synthesized DNA encoding a melanocortin receptor binding alpha-MSH mimetibody without secretory signal (p3167).
tcctactccatggagcacttccgctggggcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 127 - protein, 240 aa, Artificial Sequence
  Melanocortin receptor binding alpha-MSH mimetibody without secretory signal encoded by an in vitro synthesized DNA (p3167).
SYSMEHFRWGKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 128 - DNA, 777 bp, Artificial Sequence
  In vitro synthesized DNA encoding a melanocortin receptor binding alpha-MSH mimetibody with secretory signal (p3167).
atggcttgggtgtggaccttgctattcctgatggcggccgcccaaagtatacaggcctcctactccatggagcacttccgctggggcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 129 - protein, 259 aa, Artificial Sequence
  Melanocortin receptor binding alpha-MSH mimetibody with secretory signal encoded by an in vitro synthesized DNA (p3167).
MAWVWTLLFLMAAAQSIQASYSMEHFRWGKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 130 - DNA, 11912 bp, Artificial Sequence
  In vitro synthesized DNA with expression vector functions that encodes an alpha-MSH mimetibody (p3167).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactccatggagcacttccgctggggcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 131 - DNA, 735 bp, Artificial Sequence
  In vitro synthesized DNA encoding a melanocortin receptor binding alpha-MSH mimetibody without secretory signal (p3168).
tcctactccatggagcacttccgctggggcaagccggtggggggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 132 - protein, 245 aa, Artificial Sequence
  Melanocortin receptor binding alpha-MSH mimetibody without secretory signal encoded by an in vitro synthesized DNA (p3168).
SYSMEHFRWGKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 133 - DNA, 792 bp, Artificial Sequence
  In vitro synthesized DNA encoding a melanocortin receptor binding alpha-MSH mimetibody with secretory signal (p3168).
atggcttgggtgtggaccttgctattcctgatggcggccgcccaaagtatacaggcctcctactccatggagcacttccgctggggcaagccggtggggggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 134 - protein, 264 aa, Artificial Sequence
  Melanocortin receptor binding alpha-MSH mimetibody with secretory signal encoded by an in vitro synthesized DNA (p3168).
MAWVWTLLFLMAAAQSIQASYSMEHFRWGKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 135 - DNA, 11927 bp, Artificial Sequence
  In vitro synthesized DNA with expression vector functions that encodes an alpha-MSH mimetibody (p3168).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactccatggagcacttccgctggggcaagccggtggggggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 136 - DNA, 750 bp, Artificial Sequence
  In vitro synthesized DNA encoding a melanocortin receptor binding alpha-MSH mimetibody without secretory signal (p3169).
tcctactccatggagcacttccgctggggcaagccggtggggggcggaggaagcggcggaggcgggagcggcggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 137 - protein, 250 aa, Artificial Sequence
  Melanocortin receptor binding alpha-MSH mimetibody without secretory signal encoded by an in vitro synthesized DNA (p3169).
SYSMEHFRWGKPVGGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 138 - DNA, 807 bp, Artificial Sequence
  In vitro synthesized DNA encoding a melanocortin receptor binding alpha-MSH mimetibody with secretory signal (p3169).
atggcttgggtgtggaccttgctattcctgatggcggccgcccaaagtatacaggcctcctactccatggagcacttccgctggggcaagccggtggggggcggaggaagcggcggaggcgggagcggcggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 139 - protein, 269 aa, Artificial Sequence
  Melanocortin receptor binding alpha-MSH mimetibody with secretory signal encoded by an in vitro synthesized DNA (p3169).
MAWVWTLLFLMAAAQSIQASYSMEHFRWGKPVGGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 140 - DNA, 11942 bp, Artificial Sequence
  In vitro synthesized DNA with expression vector functions that encodes an alpha-MSH mimetibody (p3169).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactccatggagcacttccgctggggcaagccggtggggggcggaggaagcggcggaggcgggagcggcggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 141 - DNA, 765 bp, Artificial Sequence
  In vitro synthesized DNA encoding a melanocortin receptor binding alpha-MSH mimetibody without secretory signal (p3170).
tcctactccatggagcacttccgctggggcaagccggtggggggcggaggaagcggcggaggcgggagcggcggcggaggctccggtggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 142 - protein, 255 aa, Artificial Sequence
  Melanocortin receptor binding alpha-MSH mimetibody without secretory signal encoded by an in vitro synthesized DNA (p3170).
SYSMEHFRWGKPVGGGGSGGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 143 - DNA, 822 bp, Artificial Sequence
  In vitro synthesized DNA encoding a melanocortin receptor binding alpha-MSH mimetibody with secretory signal (p3170).
atggcttgggtgtggaccttgctattcctgatggcggccgcccaaagtatacaggcctcctactccatggagcacttccgctggggcaagccggtggggggcggaggaagcggcggaggcgggagcggcggcggaggctccggtggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 144 - protein, 274 aa, Artificial Sequence
  Melanocortin receptor binding alpha-MSH mimetibody with secretory signal encoded by an in vitro synthesized DNA (p3170).
MAWVWTLLFLMAAAQSIQASYSMEHFRWGKPVGGGGSGGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 145 - DNA, 11957 bp, Artificial Sequence
  In vitro synthesized DNA with expression vector functions that encodes an alpha-MSH mimetibody (p3170).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactccatggagcacttccgctggggcaagccggtggggggcggaggaagcggcggaggcgggagcggcggcggaggctccggtggcggaggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 146 - DNA, 777 bp, Artificial Sequence
  In vitro synthesized DNA encoding a melanocortin receptor binding alpha-MSH mimetibody without secretory signal (p3159).
tcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - protein, 259 aa, Artificial Sequence
  Melanocortin receptor binding alpha-MSH mimetibody without secretory signal encoded by an in vitro synthesized DNA (p3159).
SYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 148 - DNA, 834 bp, Artificial Sequence
  In vitro synthesized DNA encoding a melanocortin receptor binding alpha-MSH mimetibody with secretory signal (p3159).
atggcttgggtgtggaccttgctattcctgatggcggccgcccaaagtatacaggcctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 149 - protein, 278 aa, Artificial Sequence
  Melanocortin receptor binding alpha-MSH mimetibody with secretory signal encoded by an in vitro synthesized DNA (p3159).
MAWVWTLLFLMAAAQSIQASYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - DNA, 11969 bp, Artificial Sequence
  In vitro synthesized DNA with expression vector functions that encodes an alpha-MSH mimetibody (p3159).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 151 - DNA, 768 bp, Artificial Sequence
  In vitro synthesized DNA encoding a melanocortin receptor binding alpha-MSH mimetibody without secretory signal (p3652).
tcctactcctgcgagcacttccgctggtgcaagccggtgggatccggtggaggctccggtaccttagtcaccgtctcctcagagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 152 - protein, 256 aa, Artificial Sequence
  Melanocortin receptor binding alpha-MSH mimetibody without secretory signal encoded by an in vitro synthesized DNA (p3652).
SYSCEHFRWCKPVGSGGGSGTLVTVSSESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 153 - DNA, 825 bp, Artificial Sequence
  In vitro synthesized DNA encoding a melanocortin receptor binding alpha-MSH mimetibody with secretory signal (p3652).
atggcttgggtgtggaccttgctattcctgatggcggccgcccaaagtatacaggcctcctactcctgcgagcacttccgctggtgcaagccggtgggatccggtggaggctccggtaccttagtcaccgtctcctcagagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 154 - protein, 275 aa, Artificial Sequence
  Melanocortin receptor binding alpha-MSH mimetibody with secretory signal encoded by an in vitro synthesized DNA (p3652).
MAWVWTLLFLMAAAQSIQASYSCEHFRWCKPVGSGGGSGTLVTVSSESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 155 - DNA, 11960 bp, Artificial Sequence
  In vitro synthesized DNA with expression vector functions that encodes an alpha-MSH mimetibody (p3652).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggatccggtggaggctccggtaccttagtcaccgtctcctcagagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 156 - DNA, 777 bp, Artificial Sequence
  In vitro synthesized DNA encoding a melanocortin receptor binding alpha-MSH mimetibody without secretory signal (p3677).
tcctactcctgcgagcacttccgctggtgcaagccggtgggatccgggggaggctccggtaccttagtcaccgtctcctcagagcccaaatctgctgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 157 - protein, 259 aa, Artificial Sequence
  Melanocortin receptor binding alpha-MSH mimetibody without secretory signal encoded by an in vitro synthesized DNA (p3677).
SYSCEHFRWCKPVGSGGGSGTLVTVSSEPKSADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - DNA, 834 bp, Artificial Sequence
  In vitro synthesized DNA encoding a melanocortin receptor binding alpha-MSH mimetibody with secretory signal (p3677).
atggcttgggtgtggaccttgctattcctgatggcggccgcccaaagtatacaggcctcctactcctgcgagcacttccgctggtgcaagccggtgggatccgggggaggctccggtaccttagtcaccgtctcctcagagcccaaatctgctgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 159 - protein, 278 aa, Artificial Sequence
  Melanocortin receptor binding alpha-MSH mimetibody with secretory signal encoded by an in vitro synthesized DNA (p3677).
MAWVWTLLFLMAAAQSIQASYSCEHFRWCKPVGSGGGSGTLVTVSSEPKSADKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - DNA, 11969 bp, Artificial Sequence
  In vitro synthesized DNA with expression vector functions that encodes an alpha-MSH mimetibody (p3677).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggatccgggggaggctccggtaccttagtcaccgtctcctcagagcccaaatctgctgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 161 - DNA, 777 bp, Artificial Sequence
  In vitro synthesized DNA encoding a melanocortin receptor binding alpha-MSH mimetibody without secretory signal (p3160).
tcctactgcatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 162 - protein, 259 aa, Artificial Sequence
  Melanocortin receptor binding alpha-MSH mimetibody without secretory signal encoded by an in vitro synthesized DNA (p3160).
SYCMEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - DNA, 834 bp, Artificial Sequence
  In vitro synthesized DNA encoding a melanocortin receptor binding alpha-MSH mimetibody with secretory signal (p3160).
atggcttgggtgtggaccttgctattcctgatggcggccgcccaaagtatacaggcctcctactgcatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 164 - protein, 278 aa, Artificial Sequence
  Melanocortin receptor binding alpha-MSH mimetibody with secretory signal encoded by an in vitro synthesized DNA (p3160).
MAWVWTLLFLMAAAQSIQASYCMEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - DNA, 11969 bp, Artificial Sequence
  In vitro synthesized DNA with expression vector functions that encodes an alpha-MSH mimetibody (p3160).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactgcatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 166 - DNA, 777 bp, Artificial Sequence
  In vitro synthesized DNA encoding a melanocortin receptor binding alpha-MSH mimetibody without secretory signal (p3161).
tcctgctccatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 167 - protein, 259 aa, Artificial Sequence
  Melanocortin receptor binding alpha-MSH mimetibody without secretory signal encoded by an in vitro synthesized DNA (p3161).
SCSMEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - DNA, 834 bp, Artificial Sequence
  In vitro synthesized DNA encoding a melanocortin receptor binding alpha-MSH mimetibody with secretory signal (p3161).
atggcttgggtgtggaccttgctattcctgatggcggccgcccaaagtatacaggcctcctgctccatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 169 - protein, 278 aa, Artificial Sequence
  Melanocortin receptor binding alpha-MSH mimetibody with secretory signal encoded by an in vitro synthesized DNA (p3161).
MAWVWTLLFLMAAAQSIQASCSMEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - DNA, 11969 bp, Artificial Sequence
  In vitro synthesized DNA with expression vector functions that encodes an alpha-MSH mimetibody (p3161).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctgctccatggagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 171 - DNA, 777 bp, Artificial Sequence
  In vitro synthesized DNA encoding a melanocortin receptor binding alpha-MSH mimetibody without secretory signal (p3215).
tcctactcctgcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - protein, 259 aa, Artificial Sequence
  Melanocortin receptor binding alpha-MSH mimetibody without secretory signal encoded by an in vitro synthesized DNA (p3215).
SYSCEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - DNA, 834 bp, Artificial Sequence
  In vitro synthesized DNA encoding a melanocortin receptor binding alpha-MSH mimetibody with secretory signal (p3215).
atggcttgggtgtggaccttgctattcctgatggcggccgcccaaagtatacaggcctcctactcctgcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 174 - protein, 278 aa, Artificial Sequence
  Melanocortin receptor binding alpha-MSH mimetibody with secretory signal encoded by an in vitro synthesized DNA (p3215).
MAWVWTLLFLMAAAQSIQASYSCEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - DNA, 11969 bp, Artificial Sequence
  In vitro synthesized DNA with expression vector functions that encodes an alpha-MSH mimetibody (p3215).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 176 - DNA, 777 bp, Artificial Sequence
  In vitro synthesized DNA encoding a melanocortin receptor binding alpha-MSH mimetibody without secretory signal (p3216).
tcctactcctgcgagcacttccgctggggcaagtgcgtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 177 - protein, 259 aa, Artificial Sequence
  Melanocortin receptor binding alpha-MSH mimetibody without secretory signal encoded by an in vitro synthesized DNA (p3216).
SYSCEHFRWGKCVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - DNA, 834 bp, Artificial Sequence
  In vitro synthesized DNA encoding a melanocortin receptor binding alpha-MSH mimetibody with secretory signal (p3216).
atggcttgggtgtggaccttgctattcctgatggcggccgcccaaagtatacaggcctcctactcctgcgagcacttccgctggggcaagtgcgtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 179 - protein, 278 aa, Artificial Sequence
  Melanocortin receptor binding alpha-MSH mimetibody with secretory signal encoded by an in vitro synthesized DNA (p3216).
MAWVWTLLFLMAAAQSIQASYSCEHFRWGKCVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - DNA, 11969 bp, Artificial Sequence
  In vitro synthesized DNA with expression vector functions that encodes an alpha-MSH mimetibody (p3216).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggggcaagtgcgtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 181 - DNA, 777 bp, Artificial Sequence
  In vitro synthesized DNA encoding a melanocortin receptor binding alpha-MSH mimetibody without secretory signal (p3217).
tcctactcctgcgagcacttccgctggggcaagccgtgcggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 182 - protein, 259 aa, Artificial Sequence
  Melanocortin receptor binding alpha-MSH mimetibody without secretory signal encoded by an in vitro synthesized DNA (p3217).
SYSCEHFRWGKPCGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - DNA, 834 bp, Artificial Sequence
  In vitro synthesized DNA encoding a melanocortin receptor binding alpha-MSH mimetibody with secretory signal (p3217).
atggcttgggtgtggaccttgctattcctgatggcggccgcccaaagtatacaggcctcctactcctgcgagcacttccgctggggcaagccgtgcggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 184 - protein, 278 aa, Artificial Sequence
  Melanocortin receptor binding alpha-MSH mimetibody with secretory signal encoded by an in vitro synthesized DNA (p3217).
MAWVWTLLFLMAAAQSIQASYSCEHFRWGKPCGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - DNA, 11969 bp, Artificial Sequence
  In vitro synthesized DNA with expression vector functions that encodes an alpha-MSH mimetibody (p3217).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggggcaagccgtgcggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 186 - DNA, 777 bp, Artificial Sequence
  In vitro synthesized DNA encoding a melanocortin receptor binding alpha-MSH mimetibody without secretory signal (p3218).
tcctactgcatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 187 - protein, 259 aa, Artificial Sequence
  Melanocortin receptor binding alpha-MSH mimetibody without secretory signal encoded by an in vitro synthesized DNA (p3218).
SYCMEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - DNA, 834 bp, Artificial Sequence
  In vitro synthesized DNA encoding a melanocortin receptor binding alpha-MSH mimetibody with secretory signal (p3218).
atggcttgggtgtggaccttgctattcctgatggcggccgcccaaagtatacaggcctcctactgcatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 189 - protein, 278 aa, Artificial Sequence
  Melanocortin receptor binding alpha-MSH mimetibody with secretory signal encoded by an in vitro synthesized DNA (p3218).
MAWVWTLLFLMAAAQSIQASYCMEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - DNA, 11969 bp, Artificial Sequence
  In vitro synthesized DNA with expression vector functions that encodes an alpha-MSH mimetibody (p3218).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactgcatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 191 - DNA, 777 bp, Artificial Sequence
  In vitro synthesized DNA encoding a melanocortin receptor binding alpha-MSH mimetibody without secretory signal (p3219).
tcctgctccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 192 - protein, 259 aa, Artificial Sequence
  Melanocortin receptor binding alpha-MSH mimetibody without secretory signal encoded by an in vitro synthesized DNA (p3219).
SCSMEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - DNA, 834 bp, Artificial Sequence
  In vitro synthesized DNA encoding a melanocortin receptor binding alpha-MSH mimetibody with secretory signal (p3219).
atggcttgggtgtggaccttgctattcctgatggcggccgcccaaagtatacaggcctcctgctccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 194 - protein, 278 aa, Artificial Sequence
  Melanocortin receptor binding alpha-MSH mimetibody with secretory signal encoded by an in vitro synthesized DNA (p3219).
MAWVWTLLFLMAAAQSIQASCSMEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - DNA, 11969 bp, Artificial Sequence
  In vitro synthesized DNA with expression vector functions that encodes an alpha-MSH mimetibody (p3219).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctgctccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 196 - DNA, 777 bp, Artificial Sequence
  In vitro synthesized DNA encoding a melanocortin receptor binding alpha-MSH mimetibody without secretory signal (p3162).
tgctactccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 197 - protein, 259 aa, Artificial Sequence
  Melanocortin receptor binding alpha-MSH mimetibody without secretory signal encoded by an in vitro synthesized DNA (p3162).
CYSMEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 834 bp, Artificial Sequence
  In vitro synthesized DNA encoding a melanocortin receptor binding alpha-MSH mimetibody with secretory signal (p3162).
atggcttgggtgtggaccttgctattcctgatggcggccgcccaaagtatacaggcctgctactccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 199 - protein, 278 aa, Artificial Sequence [sequence omitted]

SEQ ID NO: 200 - DNA, 11969 bp, Artificial Sequence
  In vitro synthesized DNA with expression vector functions that encodes an alpha-MSH mimetibody (p3162).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctgctactccatggagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 201 - DNA, 720 bp, Artificial Sequence
  In vitro synthesized DNA encoding a melanocortin receptor binding alpha-MSH mimetibody without secretory signal (p3250).
tcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 202 - protein, 240 aa, Artificial Sequence
  Melanocortin receptor binding alpha-MSH mimetibody without secretory signal encoded by an in vitro synthesized DNA (p3250).
SYSCEHFRWCKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 203 - DNA, 777 bp, Artificial Sequence
  In vitro synthesized DNA encoding a melanocortin receptor binding alpha-MSH mimetibody with secretory signal (p3250).
atggcttgggtgtggaccttgctattcctgatggcggccgcccaaagtatacaggcctcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 204 - protein, 259 aa, Artificial Sequence
  Melanocortin receptor binding alpha-MSH mimetibody with secretory signal encoded by an in vitro synthesized DNA (p3250).
MAWVWTLLFLMAAAQSIQASYSCEHFRWCKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 205 - DNA, 11912 bp, Artificial Sequence
  In vitro synthesized DNA with expression vector functions that encodes an alpha-MSH mimetibody (p3250).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 206 - DNA, 735 bp, Artificial Sequence
  In vitro synthesized DNA encoding a melanocortin receptor binding alpha-MSH mimetibody without secretory signal (p3251).
tcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 207 - protein, 245 aa, Artificial Sequence
  Melanocortin receptor binding alpha-MSH mimetibody without secretory signal encoded by an in vitro synthesized DNA (p3251).
SYSCEHFRWCKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 208 - DNA, 792 bp, Artificial Sequence
  In vitro synthesized DNA encoding a melanocortin receptor binding alpha-MSH mimetibody with secretory signal (p3251).
atggcttgggtgtggaccttgctattcctgatggcggccgcccaaagtatacaggcctcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 209 - protein, 264 aa, Artificial Sequence
  Melanocortin receptor binding alpha-MSH mimetibody with secretory signal encoded by an in vitro synthesized DNA (p3251).
MAWVWTLLFLMAAAQSIQASYSCEHFRWCKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 210 - DNA, 11927 bp, Artificial Sequence
  In vitro synthesized DNA with expression vector functions that encodes an alpha-MSH mimetibody (p3251).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 211 - DNA, 735 bp, Artificial Sequence
  In vitro synthesized DNA encoding a melanocortin receptor binding alpha-MSH mimetibody without secretory signal (p3650).
tcctactcctgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 212 - protein, 245 aa, Artificial Sequence
  Melanocortin receptor binding alpha-MSH mimetibody without secretory signal encoded by an in vitro synthesized DNA (p3650).
SYSCEHFRWCKPVGGGGSGGGGSCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - DNA, 792 bp, Artificial Sequence
  In vitro synthesized DNA encoding a melanocortin receptor binding alpha-MSH mimetibody with secretory signal (p3650).
atggcttgggtgtggaccttgctattcctgatggcggccgcccaaagtatacaggcctcctactcctgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 214 - protein, 264 aa, Artificial Sequence
  Melanocortin receptor binding alpha-MSH mimetibody with secretory signal encoded by an in vitro synthesized DNA (p3650).
MAWVWTLLFLMAAAQSIQASYSCEHFRWCKPVGGGGSGGGGSCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - DNA, 11927 bp, Artificial Sequence
  Melanocortin receptor binding alpha-MSH mimetibody with secretory signal encoded by an in vitro synthesized DNA (p3650).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 216 - DNA, 735 bp, Artificial Sequence
  In vitro synthesized DNA encoding a melanocortin receptor binding alpha-MSH mimetibody without secretory signal (p3651).
tcctactcctgcgagcacttccgctggtgcaagccggtgggaggcggaggaagcggcggaggcggatcctgcccaccgtgcccagcacctgaagccgctgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 217 - protein, 245 aa, Artificial Sequence
  Melanocortin receptor binding alpha-MSH mimetibody without secretory signal encoded by an in vitro synthesized DNA (p3651).
SYSCEHFRWCKPVGGGGSGGGGSCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - DNA, 792 bp, Artificial Sequence
  In vitro synthesized DNA encoding a melanocortin receptor binding alpha-MSH mimetibody with secretory signal (p3651).
atggcttgggtgtggaccttgctattcctgatggcggccgcccaaagtatacaggcctcctactcctgcgagcacttccgctggtgcaagccggtgggaggcggaggaagcggcggaggcggatcctgcccaccgtgcccagcacctgaagccgctgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 264 aa, Artificial Sequence
  Melanocortin receptor binding alpha-MSH mimetibody with secretory signal encoded by an in vitro synthesized DNA (p3651).
MAWVWTLLFLMAAAQSIQASYSCEHFRWCKPVGGGGSGGGGSCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - DNA, 11927 bp, Artificial Sequence
  In vitro synthesized DNA with expression vector functions that encodes an alpha-MSH mimetibody (p3651).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactcctgcgagcacttccgctggtgcaagccggtgggaggcggaggaagcggcggaggcggatcctgcccaccgtgcccagcacctgaagccgctgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 221 - DNA, 729 bp, Artificial Sequence
  In vitro synthesized DNA encoding a melanocortin receptor binding alpha-MSH mimetibody without secretory signal (p3390).
cagatccagtcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 222 - protein, 243 aa, Artificial Sequence
  Melanocortin receptor binding alpha-MSH mimetibody without secretory signal encoded by an in vitro synthesized DNA (p3390).
QIQSYSCEHFRWCKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 223 - DNA, 786 bp, Artificial Sequence
  In vitro synthesized DNA encoding a melanocortin receptor binding alpha-MSH mimetibody with secretory signal and V1 (p3390).
atggcttgggtgtggaccttgctattcctgatggcggccgcccaaagtatacaggcccagatccagtcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 224 - protein, 262 aa, Artificial Sequence
  Melanocortin receptor binding alpha-MSH mimetibody with secretory signal and V1 encoded by an in vitro synthesized DNA (p3390).
MAWVWTLLFLMAAAQSIQAQIQSYSCEHFRWCKPVGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 225 - DNA, 11921 bp, Artificial Sequence
  In vitro synthesized DNA with expression vector functions that encodes an alpha-MSH mimetibody (p3390).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcccagatccagtcctactcctgcgagcacttccgctggtgcaagccggtgggaggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 226 - DNA, 744 bp, Artificial Sequence
  In vitro synthesized DNA encoding a melanocortin receptor binding alpha-MSH mimetibody without secretory signal (p3391).
cagatccagtcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 227 - protein, 248 aa, Artificial Sequence
  Melanocortin receptor binding alpha-MSH mimetibody without secretory signal encoded by an in vitro synthesized DNA (p3391).
QIQSYSCEHFRWCKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 228 - DNA, 801 bp, Artificial Sequence
  In vitro synthesized DNA encoding a melanocortin receptor binding alpha-MSH mimetibody with secretory signal and V1 (p3391).
atggcttgggtgtggaccttgctattcctgatggcggccgcccaaagtatacaggcccagatccagtcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaa

SEQ ID NO: 229 - protein, 267 aa, Artificial Sequence
  Melanocortin receptor binding alpha-MSH mimetibody with secretory signal and V1 encoded by an in vitro synthesized DNA (p3391).
MAWVWTLLFLMAAAQSIQAQIQSYSCEHFRWCKPVGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSLGK

SEQ ID NO: 230 - DNA, 11936 bp, Artificial Sequence
  In vitro synthesized DNA with expression vector functions that encodes an alpha-MSH mimetibody (p3391).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcccagatccagtcctactcctgcgagcacttccgctggtgcaagccggtgggaggcggaggaagcggcggaggcggatcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 231 - DNA, 792 bp, Artificial Sequence
  In vitro synthesized DNA encoding a melanocortin receptor binding alpha-MSH mimetibody without secretory signal (p3458).
cagatccagggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 232 - protein, 264 aa, Artificial Sequence
  Melanocortin receptor binding alpha-MSH mimetibody without secretory signal encoded by an in vitro synthesized DNA (p3458).
QIQGGSYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - DNA, 849 bp, Artificial Sequence
  In vitro synthesized DNA encoding a melanocortin receptor binding alpha-MSH mimetibody with secretory signal and V1 (p3458).
atggcttgggtgtggaccttgctattcctgatggcggccgcccaaagtatacaggcccagatccagggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 234 - protein, 283 aa, Artificial Sequence
  Melanocortin receptor binding alpha-MSH mimetibody with secretory signal and V1 encoded by an in vitro synthesized DNA (p3458).
MAWVWTLLFLMAAAQSIQAQIQGGSYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - DNA, 11984 bp, Artificial Sequence
  In vitro synthesized DNA with expression vector functions that encodes an alpha-MSH mimetibody (p3458).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcccagatccagggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 236 - DNA, 798 bp, Artificial Sequence
  In vitro synthesized DNA encoding a melanocortin receptor binding alpha-MSH mimetibody without secretory signal (p3459).
cagatccagggaggcggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 266 aa, Artificial Sequence
  Melanocortin receptor binding alpha-MSH mimetibody without secretory signal encoded by an in vitro synthesized DNA (p3459).
QIQGGGGSYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - DNA, 855 bp, Artificial Sequence
  In vitro synthesized DNA encoding a melanocortin receptor binding alpha-MSH mimetibody with secretory signal and V1 (p3459).
atggcttgggtgtggaccttgctattcctgatggcggccgcccaaagtatacaggcccagatccagggaggcggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 239 - protein, 285 aa, Artificial Sequence
  Melanocortin receptor binding alpha-MSH mimetibody with secretory signal and V1 encoded by an in vitro synthesized DNA (p3459).
MAWVWTLLFLMAAAQSIQAQIQGGGGSYSCEHFRWCKPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - DNA, 11990 bp, Artificial Sequence
  In vitro synthesized DNA with expression vector functions that encodes an alpha-MSH mimetibody (p3459).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcccagatccagggaggcggaggctcctactcctgcgagcacttccgctggtgcaagccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 241 - DNA, 777 bp, Artificial Sequence
  In vitro synthesized DNA encoding a melanocortin receptor binding alpha-MSH mimetibody without secretory signal (p3560).
tcctactgcggcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 242 - protein, 259 aa, Artificial Sequence
  Melanocortin receptor binding alpha-MSH mimetibody without secretory signal encoded by an in vitro synthesized DNA (p3560).
SYCGEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - DNA, 834 bp, Artificial Sequence
  In vitro synthesized DNA encoding a melanocortin receptor binding alpha-MSH mimetibody with secretory signal (p3560).
atggcttgggtgtggaccttgctattcctgatggcggccgcccaaagtatacaggcctcctactgcggcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 244 - protein, 278 aa, Artificial Sequence
  Melanocortin receptor binding alpha-MSH mimetibody with secretory signal encoded by an in vitro synthesized DNA (p3560).
MAWVWTLLFLMAAAQSIQASYCGEHFRWGCPVGSGGGSGTLVAVSSEPKSADKTHACPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - DNA, 11969 bp, Artificial Sequence
  In vitro synthesized DNA with expression vector functions that encodes an alpha-MSH mimetibody (p3560).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggcctcctactgcggcgagcacttccgctggggctgcccggtgggatccggtggaggctccggtaccttagtcgccgtctcctcagagcccaaatctgccgacaaaactcacgcctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 246 - DNA, 330 bp, Homo sapiens
gcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaa

SEQ ID NO: 247 - protein, 110 aa, Homo sapiens; identical to SEQ ID NO: 50

SEQ ID NO: 248 - DNA, 21 bp, Artificial Sequence
  In vitro mutagenized Homo sapien DNA encoding a V2 peptide sequence comprising a T to A substitution to limit O-linked glycosylation.
accttagtcaccgtctcctca

SEQ ID NO: 249 - protein, 7 aa, Artificial Sequence
  Mutagenized Homo sapien V2 peptide comprising a T to A substitution to limit O-linked glycosylation and encoded by an in vitro mutagenized Homo sapien DNA.
TLVTVSS

SEQ ID NO: 250 - DNA, 732 bp, Artificial Sequence
  In vitro synthesized DNA encoding a melanocortin receptor binding alpha-MSH mimetibody without secretory signal (p4362).
ggcggatgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 251 - protein, 244 aa, Artificial Sequence
  Melanocortin receptor binding alpha-MSH mimetibody without secretory signal encoded by an in vitro synthesized DNA (p4362).
GGCEHFRWCKPVGGGGSGGGGSCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 252 - DNA, 789 bp, Artificial Sequence
  In vitro synthesized DNA encoding a melanocortin receptor binding alpha-MSH mimetibody with secretory signal (p4362).
atggcttgggtgtggaccttgctattcctgatggcggccgcccaaagtatacaggccggcggatgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 253 - protein, 263 aa, Artificial Sequence
  Melanocortin receptor binding alpha-MSH mimetibody with secretory signal encoded by an in vitro synthesized DNA (p4362).
MAWVWTLLFLMAAAQSIQAGGCEHFRWCKPVGGGGSGGGGSCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 254 - DNA, 11924 bp, Artificial Sequence
  In vitro synthesized DNA with expression vector functions that encodes an alpha-MSH mimetibody (p4362).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggccggcggatgcgagcacttccgctggtgcaagccggtgggaggcggaggaagcggcggaggcggatcctgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 255 - DNA, 753 bp, Artificial Sequence
  In vitro synthesized DNA encoding a melanocortin receptor binding alpha-MSH mimetibody without secretory signal (p4371).
ggcggatgcgagcacttccgctggtgcaagccggtgggatccggtaccttagtcaccaactccaccgagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 256 - protein, 251 aa, Artificial Sequence
  Melanocortin receptor binding alpha-MSH mimetibody without secretory signal encoded by an in vitro synthesized DNA (p4371).
GGCEHFRWCKPVGSGTLVTNSTESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 257 - DNA, 810 bp, Artificial Sequence
  In vitro synthesized DNA encoding a melanocortin receptor binding alpha-MSH mimetibody with secretory signal (p4371).
atggcttgggtgtggaccttgctattcctgatggcggccgcccaaagtatacaggccggcggatgcgagcacttccgctggtgcaagccggtgggatccggtaccttagtcaccaactccaccgagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 258 - protein, 270 aa, Artificial Sequence
  Melanocortin receptor binding alpha-MSH mimetibody with secretory signal encoded by an in vitro synthesized DNA (p4371).
MAWVWTLLFLMAAAQSIQAGGCEHFRWCKPVGSGTLVTNSTESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 259 - DNA, 11945 bp, Artificial Sequence
  In vitro synthesized DNA with expression vector functions that encodes an alpha-MSH mimetibody (p4371).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggccggcggatgcgagcacttccgctggtgcaagccggtgggatccggtaccttagtcaccaactccaccgagtccaaatatggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 260 - DNA, 747 bp, Artificial Sequence
  In vitro synthesized DNA encoding a melanocortin receptor binding alpha-MSH mimetibody without secretory signal (p4372).
ggcggatgcgagcacttccgctggtgcaagccggtgggaggcggatccggtaccttagtcaccaactccaccggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 261 - protein, 249 aa, Artificial Sequence
  In vitro synthesized DNA encoding a melanocortin receptor binding alpha-MSH mimetibody without secretory signal (p4372).
GGCEHFRWCKPVGGGSGTLVTNSTGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 262 - DNA, 804 bp, Artificial Sequence
  In vitro synthesized DNA encoding a melanocortin receptor binding alpha-MSH mimetibody with secretory signal (p4372).
atggcttgggtgtggaccttgctattcctgatggcggccgcccaaagtatacaggccggcggatgcgagcacttccgctggtgcaagccggtgggaggcggatccggtaccttagtcaccaactccaccggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 263 - protein, 268 aa, Artificial Sequence
  Melanocortin receptor binding alpha-MSH mimetibody with secretory signal encoded by an in vitro synthesized DNA (p4372).
MAWVWTLLFLMAAAQSIQAGGCEHFRWCKPVGGGSGTLVTNSTGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 264 - DNA, 11939 bp, Artificial Sequence
  In vitro synthesized DNA with expression vector functions that encodes an alpha-MSH mimetibody (p4372).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggccggcggatgcgagcacttccgctggtgcaagccggtgggaggcggatccggtaccttagtcaccaactccaccggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 265 - DNA, 747 bp, Artificial Sequence
  In vitro synthesized DNA encoding a melanocortin receptor binding alpha-MSH mimetibody without secretory signal (p4383).
ggcggatgcgagcacttccgctggtgcaagccggtgggtggaggctccggtaccaacgtcaccgtctccgcaggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 266 - protein, 249 aa, Artificial Sequence
  Melanocortin receptor binding alpha-MSH mimetibody without secretory signal encoded by an in vitro synthesized DNA (p4383).
GGCEHFRWCKPVGGGSGTNVTVSAGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 267 - DNA, 804 bp, Artificial Sequence
  In vitro synthesized DNA encoding a melanocortin receptor binding alpha-MSH mimetibody with secretory signal (p4383).
atggcttgggtgtggaccttgctattcctgatggcggccgcccaaagtatacaggccggcggatgcgagcacttccgctggtgcaagccggtgggtggaggctccggtaccaacgtcaccgtctccgcaggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaa

SEQ ID NO: 268 - protein, 268 aa, Artificial Sequence
  Melanocortin receptor binding alpha-MSH mimetibody with secretory signal encoded by an in vitro synthesized DNA (p4383).
MAWVWTLLFLMAAAQSIQAGGCEHFRWCKPVGGGSGTNVTVSAGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 269 - DNA, 11939 bp, Artificial Sequence
  In vitro synthesized DNA with expression vector functions that encodes an alpha-MSH mimetibody (p4383).
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagagtctataggcccacctccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagcttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttagatctgtctagaagctgggtaccagctgctagcgccaccatggcttgggtgtggaccttgctattcctgatggcggccgcccaaagtatacaggccggcggatgcgagcacttccgctggtgcaagccggtgggtggaggctccggtaccaacgtcaccgtctccgcaggtcccccatgcccaccatgcccggcgcctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagcctcgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaaaagcttgtccctgtctctgggtaaatgagggcccgtttaaacagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatccggctgcctcgcgcgtttcggtgatgacggtgaaaacctctgacacatgcagctcccggagacggtcacagcttgtctgtaagcggatgccgggagcagacaagcccgtcaggcgtcagcgggtgttggcgggtgtcggggcgcagccatgaggtcgactctagaggatcgatgccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgcatatacagtcagcatatgatacccagtagtagagtgggagtgctatcctttgcatatgccgccacctcccaagggggcgtgaattttcgctgcttgtccttttcctgctggttgctcccattcttaggtgaatttaaggaggccaggctaaagccgtcgcatgtctgattgctcaccaggtaaatgtcgctaatgttttccaacgcgagaaggtgttgagcgcggagctgagtgacgtgacaacatgggtatgcccaattgccccatgttgggaggacgaaaatggtgacaagacagatggccagaaatacaccaacagcacgcatgatgtctactggggatttattctttagtgcgggggaatacacggcttttaatacgattgagggcgtctcctaacaagttacatcactcctgcccttcctcaccctcatctccatcacctccttcatctccgtcatctccgtcatcaccctccgcggcagccccttccaccataggtggaaaccagggaggcaaatctactccatcgtcaaagctgcacacagtcaccctgatattgcaggtaggagcgggctttgtcataacaaggtccttaatcgcatccttcaaaacctcagcaaatatatgagtttgtaaaaagaccatgaaataacagacaatggactcccttagcgggccaggttgtgggccgggtccaggggccattccaaaggggagacgactcaatggtgtaagacgacattgtggaatagcaagggcagttcctcgccttaggttgtaaagggaggtcttactacctccatatacgaacacaccggcgacccaagttccttcgtcggtagtcctttctacgtgactcctagccaggagagctcttaaaccttctgcaatgttctcaaatttcgggttggaacctccttgaccacgatgcttttccaaaccaccctccttttttgcgccctgcctccatcaccctgaccccggggtccagtgcttgggccttctcctgggtcatctgcggggccctgctctatcgctcccgggggcacgtcaggctcaccatctgggccaccttcttggtggtattcaaaataatcggcttcccctacagggtggaaaaatggccttctacctggagggggcctgcgcggtggagacccggatgatgatgactgactactgggactcctgggcctcttttctccacgtccacgacctctccccctggctctttcacgacttccccccctggctctttcacgtcctctaccccggcggcctccactacctcctcgaccccggcctccactacctcctcgaccccggcctccactgcctcctcgaccccggcctccacctcctgctcctgcccctcctgctcctgcccctcctcctgctcctgcccctcctgcccctcctgctcctgcccctcctgcccctcctgctcctgcccctcctgcccctcctgctcctgcccctcctgcccctcctcctgctcctgcccctcctgcccctcctcctgctcctgcccctcctgcccctcctgctcctgcccctcctgcccctcctgctcctgcccctcctgcccctcctgctcctgcccctcctgctcctgcccctcctgctcctgcccctcctgctcctgcccctcctgcccctcctgcccctcctcctgctcctgcccctcctgctcctgcccctcctgcccctcctgcccctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctgcccctcctcctgctcctgcccctcctcctgctcctgcccctcctgcccctcctgcccctcctcctgctcctgcccctcctcctgctcctgcccctcctgcccctcctgcccctcctgcccctcctcctgctcctgcccctcctcctgctcctgcccctcctgctcctgcccctcccgctcctgctcctgctcctgttccaccgtgggtccctttgcagccaatgcaacttggacgtttttggggtctccggacaccatctctatgtcttggccctgatcctgagccgcccggggctcctggtcttccgcctcctcgtcctcgtcctcttccccgtcctcgtccatggttatcaccccctcttctttgaggtccactgccgccggagccttctggtccagatgtgtctcccttctctcctaggccatttccaggtcctgtacctggcccctcgtcagacatgattcacactaaaagagatcaatagacatctttattagacgacgctcagtgaatacagggagtgcagactcctgccccctccaacagcccccccaccctcatccccttcatggtcgctgtcagacagatccaggtctgaaaattccccatcctccgaaccatcctcgtcctcatcaccaattactcgcagcccggaaaactcccgctgaacatcctcaagatttgcgtcctgagcctcaagccaggcctcaaattcctcgtccccctttttgctggacggtagggatggggattctcgggacccctcctcttcctcttcaaggtcaccagacagagatgctactggggcaacggaagaaaagctgggtgcggcctgtgaggatcagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatcccggggggcaatgagatatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccggatcgggagatgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagccactggccccgtgggttagggacggggtcccccatggggaatggtttatggttcgtgggggttattattttgggcgttgcgtggggtcaggtccacgactggactgagcagacagacccatggtttttggatggcctgggcatggaccgcatgtactggcgcgacacgaacaccgggcgtctgtggctgccaaacacccccgacccccaaaaaccaccgcgcggatttctggcgtgccaagctagtcgaccaattctcatgtttgacagcttatcatcgcagatccgggcaacgttgttgccattgctgcaggcgcagaactggtaggtatggaagatctatacattgaatcaatattggcaattagccatattagtcattggttatatagcataaatcaatattggctattggccattgcatacgttgtatctatatcataatatgtacatttatattggctcatgtccaatatgaccgccat

SEQ ID NO: 270 - DNA, 36 bp, Artificial Sequence
  In vitro synthesized DNA encoding a constrained peptide sequence.
ggcggatgcgagcacttccgctggtgcaagccggtg

SEQ ID NO: 271 - protein, 12 aa, Artificial Sequence
  Constrained peptide encoded by an in vitro synthesized DNA.
GGCEHFRWCKPV

SEQ ID NO: 272 - DNA, 9 bp, Artificial Sequence
  In vitro synthesized DNA encoding a flexible peptide sequence.
ggatccggt

SEQ ID NO: 273 - protein, 3 aa, Artificial Sequence
  Flexible peptide encoded by an in vitro synthesized DNA.
GSG

SEQ ID NO: 274 - DNA, 21 bp, Artificial Sequence
  In vitro mutagenized Homo sapien DNA encoding a V2 peptide sequence comprising a V to N substitution to increase N-linked glycosylation and a S to T substitution to increase O-linked glycosylation.
accttagtcaccaactccacc

SEQ ID NO: 275 - protein, 7 aa, Artificial Sequence
  Mutagenized Homo sapien V2 peptide comprising a V to N substitution to increase N-linked glycosylation and a S to T subsutition to improve O-linked glycosylation and encoded by an in vitro
  mutagenized Homo sapien DNA.
TLVTNST

SEQ ID NO: 276 - DNA, 15 bp, Artificial Sequence
  In vitro synthesized DNA encoding a flexible peptide sequence.
ggaggcggatccggt

SEQ ID NO: 277 - protein, 5 aa, Artificial Sequence
  Flexible peptide encoded by an in vitro synthesized DNA.
GGGSG

SEQ ID NO: 278 - DNA, 21 bp, Artificial Sequence
  In vitro mutagenized Homo sapien DNA encoding a V2 peptide sequence comprising a L to N substitution to increase N-linked glycosylation and a S to A substitution to increase N-linked glycosylation.
accaacgtcaccgtctccgca

SEQ ID NO: 279 - protein, 7 aa, Artificial Sequence
  Mutagenized Homo sapien V2 peptide comprising a V to N substitution to increase N-linked glycosylation and a S to T subsutition to increase O-linked glycosylation and encoded by an in vitro
  mutagenized Homo sapien DNA.
TNVTVSA

SEQ ID NO: 280 - DNA, 24 bp, Artificial Sequence
  In vitro synthesized DNA encoding a flexible peptide sequence.
ggtcccccatgcccaccatgcccg

SEQ ID NO: 281 - protein, 8 aa, Artificial Sequence
  Flexible peptide encoded by an in vitro synthesized DNA.
GPPCPPCP

SEQ ID NO: 282 - protein, 12 aa, Artificial Sequence
  Constrained peptide encoded by an in vitro synthesized DNA
GGCEHFRWCKPV

The invention claimed is:

1. A polypeptide having the sequence shown in SEQ ID NO: 212.

2. A pharmaceutical composition comprising the polypeptide of claim 1 and a pharmaceutically acceptable carrier or diluent.

3. A method of modifying the biological activity of a melanocortin receptor in a cell, tissue or organ comprising contacting an effective amount of the pharmaceutical composition of claim 2 with the cell, tissue or organ.

4. A method of modulating at least one melanocortin receptor mediated condition comprising administering an effective amount of the pharmaceutical composition of claim 2 to a patient in need thereof.

5. The method of claim 4 wherein the melanocortin receptor mediated condition is obesity.

* * * * *